(12) United States Patent
Baum et al.

(10) Patent No.: US 8,476,409 B2
(45) Date of Patent: Jul. 2, 2013

(54) BISPECIFIC ANTI-IGF-1R AND ANTI-ERBB3 ANTIBODIES

(75) Inventors: Jason Baum, Needham, MA (US); Bryan Johnson, Natick, MA (US); Alexey Alexandrovich Lugovskoy, Woburn, MA (US); Lihui Xu, Chestnut Hill, MA (US); Neeraj Kohli, Brighton, MA (US); Jonathan Basil Fitzgerald, Arlington, MA (US); Sharlene Adams, Waltham, MA (US)

(73) Assignee: Merrimack Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 13/451,135

(22) Filed: Apr. 19, 2012

(65) Prior Publication Data
US 2012/0269812 A1    Oct. 25, 2012

Related U.S. Application Data

(60) Provisional application No. 61/477,089, filed on Apr. 19, 2011, provisional application No. 61/539,297, filed on Sep. 26, 2011, provisional application No. 61/558,192, filed on Nov. 10, 2011, provisional application No. 61/619,244, filed on Apr. 2, 2012.

(51) Int. Cl.
*C07K 16/30*    (2006.01)
*C07H 21/04*    (2006.01)
*A61K 39/00*    (2006.01)

(52) U.S. Cl.
USPC .......... 530/387.3; 530/387.5; 530/387.7; 424/133.1; 424/136.1; 424/138.1

(58) Field of Classification Search
None
See application file for complete search history.

(56) References Cited

U.S. PATENT DOCUMENTS

| 7,846,440 | B2 | 12/2010 | Schoeberl et al. |
| 7,960,142 | B2* | 6/2011 | Glaser et al. ................. 435/69.1 |
| 2009/0048122 | A1* | 2/2009 | Glaser et al. .................... 506/12 |
| 2010/0322935 | A1* | 12/2010 | Croasdale et al. ......... 424/136.1 |
| 2012/0107306 | A1* | 5/2012 | Elis et al. ................... 424/133.1 |
| 2012/0244163 | A1* | 9/2012 | Schoeberl et al. ......... 424/136.1 |

FOREIGN PATENT DOCUMENTS

| WO | WO 2008/100624 A2 | 8/2008 |
| WO | WO 2009/126920 A2 | 10/2009 |
| WO | WO 2011047180 A1 * | 4/2011 |

OTHER PUBLICATIONS

Desbois-Mouthon Christele et al: "Insulin-like growth factor-I receptor inhibition induces a resistance mechanism via the epidermal growth factor receptor/HER3/AKT signaling pathway: rational basis for cotargeting insulin-like growth factor-I receptor and epidermal growth factor receptor in hepatocellular carcinoma.", Clinical Cancer Research: An Official Journal of the American Association for Cancer Research Sep. 1, 2009 LNKDPUBMED: 19706799, vol. 15, No. 17, Sep. 1, 2009, pp. 5445-5456, XP007917001.

Haluska Paul et al: "HER receptor signaling confers resistance to the insulin-like growth factor-I receptor inhibitor, BMS-536924", Molecular Cancer Therapeutics, vol. 7, No. 9, Sep. 2008, pp. 2589-2598, XP007917004.

Lu Dan et al: "A fully human recombinant IgG-like bispecific antibody to both the epidermal growth factor receptor and the insulin-like growth factor receptor for enhanced antitumor activity", Journal of Biological Chemistry, American Society for Biochemistry and Molecular Biology, Inc, US, vol. 280, No. 20, May 20, 2005, pp. 19665-19672, XP002516978.

International Search Report & Written Opinion from PCT/US2010/052712, dated Feb. 17, 2011.

* cited by examiner

*Primary Examiner* — Sheela J Huff
*Assistant Examiner* — Jessica H Roark
(74) *Attorney, Agent, or Firm* — Lathrop & Gage LLP; James H. Velema, Esq.

(57) ABSTRACT

Provided are bispecific antibodies that are useful as antineoplastic agents and that bind specifically to human IGF-1R and human ErbB3. Exemplary antibodies inhibit signal transduction through either or both of IGF-1R and ErbB3.

15 Claims, 139 Drawing Sheets

Fig. 1A

```
                                                  80       90      100[S.304]110      120
                                  ....|....|....|....|....|....|....|....|....|....|..
IGF-1R Heavy Chain Consensus      SRDNSKNTLYLQMNSLRXEDTAVYYCAKDFYXXLTGNAFDXWGQGTXVTVSS  SEQ ID NO: 1
M57 Heavy Chain                   .................A.............TW.......S.....S.....  SEQ ID NO: 8
M78 Heavy Chain                   .................P.............TI.......M.....S.....  SEQ ID NO: 9
P4 Heavy Chain                    .................A.............QI.......Y.....T.....  SEQ ID NO: 10
SF Heavy Chain                    .................A.............DI.......I.....T.....  SEQ ID NO: 11
5-7lib6PR3-2-54-app8F2            .................P.............DM.......K.....S.....
5-7lib6PR3-2-13-app8F2            .................P.............TM.......E.....T.....
5-7Lib6pr3p19                     .................A.............YM.......V.....T.....
5-7Lib6pr3p23                     .................P.............TL.......M.....T.....
5-7Lib6pr3p4                      .................A.............QI.......Y.....T.....
5-7Lib6pr3p43                     .................A.............NI.......A.....T.....
5-7-lib6-14                       .................A.............RM.......R.....S.....
5-7-lib6-25                       .................A.............WM.......T.....T.....
5-7-lib6-27                       .................A.............QI.......Y.....S.....
5-7-lib6-57                       .................A.............TW.......S.....S.....
5-7-lib6-65                       .................P.............FM.......E.....S.....
5-7-lib6-66                       .................A.............TW.......M.....S.....
5-7-lib6-67                       .................P.............HI.......N.....T.....
5-7-lib6-77                       .................P.............NI.......R.....S.....
5-7-lib6-78                       .................P.............TI.......M.....S.....
5-7-lib6-80                       .................A.............MI.......T.....T.....
5-7-lib6-86                       .................A.............KI.......M.....S.....
5-7-lib6-93                       .................A.............WM.......V.....S.....
5-7-lib6-48                       .................P.............WM.......K.....T.....
5-7-lib6-76                       .................P.............NI.......K.....S.....  SEQ ID NO: 31
P4M                               .................A.............QI.......Y.....T.....  SEQ ID NO: 384
P33M                              .................A.............TI.......T.....T.....  SEQ ID NO: 385
```

| | | | SEQ ID NO: 133 |
|---|---|---|---|
| | | | SEQ ID NO: 386 |
| | | | SEQ ID NO: 387 |

| | | | |
|---|---|---|---|
| 5-7-11b6-16 | .A. | .TF. | |
| 5-7-11b6-17 | .G. | .TW. | |
| 5-7-11b6-18 | .A. | .SW. | |
| 5-7-11b6-19 | .G. | .RF. | |
| 5-7-11b6-2 | .A. | .TF. | |
| 5-7-11b6-20 | .A. | .TF. | |
| 5-7-11b6-21 | .A. | .RW. | |
| 5-7-11b6-22 | .A. | .WW. | |
| 5-7-11b6-24 | .A. | .TF. | |
| 5-7-11b6-25 | .A. | .RF. | |
| 5-7-11b6-26 | .G. | .TF. | |
| 5-7-11b6-27 | .G. | .RW. | |
| 5-7-11b6-30 | .G. | .RF. | |
| 5-7-11b6-32 | .A. | .MF. | |
| 5-7-11b6-39 | .G. | .SF. | |
| 5-7-11b6-40 | .G. | .MF. | |
| 5-7-11b6-42 | .A. | .SF. | |
| 5-7-11b6-43 | .G. | .TW. | |
| 5-7-11b6-45 | .A. | .SF. | |
| 5-7-11b6-47 | .G. | .RF. | |
| 5-7-11b6-51 | .A. | .RW. | |
| 5-7-11b6-52 | .A. | .OF. | |
| 5-7-11b6-55 | .G. | .TW. | |
| 5-7-11b6-57 | .A. | .SF. | |
| 5-7-11b6-62 | .A. | .FW. | |
| 5-7-11b6-64 | .G. | .LF. | |
| 5-7-11b6-65 | .G. | .WF. | |
| 5-7-11b6-67 | .A. | .MF. | |
| 5-7-11b6-68 | .A. | .RW. | |
| 5-7-11b6-69 | .G. | .TF. | |
| 5-7-11b6-70 | .A. | .LF. | |
| 5-7-11b6-72 | .G. | .FF. | |
| 5-7-11b6-77 | .A. | .AF. | |
| 5-7-11b6-78 | .G. | .TF. | |
| 5-7-11b6-79 | .A. | .VW. | |
| 5-7-11b6-86 | .G. | .TW. | |
| 5-7-11b6-90 | .G. | .TF. | |
| 5-7-11b6-91 | .A. | .TW. | |
| 5-7-11b6-92 | .G. | .TF. | |
| 5-7-11b6-48 | .G. | .TF. | |
| P4M KAPPA LIGHT CHAIN | .FA. | .TF. | |
| P33M KAPPA LIGHT CHAIN | .FA. | .RW. | |

| | 80 | 90 | 100[S.311]110 | 120 | | |
|---|---|---|---|---|---|---|
| ErbB3 Heavy Chain Consensus | SRDNAKNSLYLQMNSLRXEDTAXYYCARDLGXXQWXXGFDYWGQGTLVTVSS | | | | SEQ ID NO: | 4 |
| ErbB3 Heavy Chain Consensus | SRDNAKNSLYLQMNSLRAEDTALYYCARDLGXXQWXXGFDYWGQGTLVTVSS | | | | SEQ ID NO: | 5 |
| B60 Heavy Chain | ................................AY..EE.............. | | | | SEQ ID NO: | 134 |
| B72 Heavy Chain | ................................FN..EE.............. | | | | SEQ ID NO: | 135 |
| M27 Heavy Chain | ................................FN..VD.............. | | | | SEQ ID NO: | 136 |
| M7 Heavy Chain | ................................YN..NE.............. | | | | SEQ ID NO: | 137 |
| P1 Heavy Chain | ................................AY..VE.............. | | | | SEQ ID NO: | 138 |
| M27 Heavy Chain | ................................FN..VD.............. | | | | SEQ ID NO: | 139 |
| B69 Heavy Chain | ................................YN..LE.............. | | | | SEQ ID NO: | 140 |
| P6 Heavy Chain | ................................AX..VE.............. | | | | SEQ ID NO: | 141 |
| M1.3 Heavy Chain | ................................YN..VE.............. | | | | SEQ ID NO: | 142 |
| C8 Heavy Chain | ................................AK..LE.............. | | | | SEQ ID NO: | 143 |
| E3B-M20 | ................................AF..EE.............. | | | | | |
| E3B-M73 | ................................AF..QE.............. | | | | | |
| E3B-B40 | ................................AM..VE.............. | | | | | |
| E3B-M64 | ................................FN..NE.............. | | | | | |
| E3B-M11 | ................................FN..NE.............. | | | | | |
| E3B-B10 | ................P...V..........FN..NE.............. | | | | | |
| E3B-M89 | ................................FN..LE.............. | | | | | |
| E3B-B68 | ................................FM..VD.............. | | | | | |
| E3B-B63 | ................................YN..VE.............. | | | | | |
| E3B-M35 | ................................YN..LD.............. | | | | | |
| E3B-B4 | ................................YN..LE.............. | | | | | |
| E3B-B53 | ................................YN..LE.............. | | | | | |
| E3B-B85 | ................................YN..LE.............. | | | | | |
| E3B-B84 | ................................YN..LE.............. | | | | | |
| E3B-B67 | ................................YN..QE.............. | | | | | |
| E3B-M45 | ................................YN..NE.............. | | | | | |
| E3B-B58 | ................................YS..VE.............. | | | | | |
| E3B-M7 | ................................AX..EE.............. | | | | | |
| E3B-M54 | ................................FN..VE.............. | | | | | |
| E3B-B70 | ................................FM..VD.............. | | | | | |
| E3B-B36 | ................................YN..LE.............. | | | | | |
| E3B-P28 | | | | | SEQ ID NO: | 165 |
| P6L | | | | | SEQ ID NO: | 388 |

Anti-IGF-1R-IgG1/anti-ErbB3 BISPECIFICS

LIGHT CHAINS

SF KAPPA LIGHT CHAIN

DIQMTQSPSSLSASTGDRVTITCRASQGISSYLAWYQQKPGKAPKLLIYAASTLQS
GVPSRFSGSGSGTDFTLTISSLQPEDFATYYCQQYFTFPLTFGGGTKVEIKRTVAA
PSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC
(SEQ ID NO: 202)

P4 KAPPA LIGHT CHAIN

DIQMTQSPSSLSASLGDRVTITCRASQGISSYLAWYQQKPGKAPKLLIYAKSTLQS
GVPSRFSGSGSGTDFTLTISSLQPEDSATYYCQQYWTFPLTFGGGTKVEIKRTVAA
PSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC
(SEQ ID NO: 204)

M78 KAPPA LIGHT CHAIN

DIQMTQSPSSLSASLGDRVTITCRASQGISSYLAWYQQKPGKAPKLLIYASSTRQS
GVPSRFSGSGSGTDFTLTISSLQPEDSGTYYCQQYWAFPLTFGGGTKVEIKRTVA
APSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC
(SEQ ID NO: 206)

M57 KAPPA LIGHT CHAIN

DIQLTQSPSSLSASLGDRVTITCRASQGISSYLAWYQQKPGKAPKLLIYARSTRQS
GVPSRFSGSGSGTEFTLTISSLQPEDSATYYCQQYWTWPLTFGGGTKVEIKRTVA
APSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC
(SEQ ID NO: 208)

HEAVY CHAINS

SF-G1-C8

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL

Fig. 5A

LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGGGGGSGGGGSGGGGSQVQLVQSG
GGLVQPGGSLRLSCAASGFTFDDYAMHWVRQAPGKGLEWVAGISWNSGSIGYADSVK
GRFTISRDNAKNSLYLQMNSLRPEDTAVYYCARDLGYNQWVEGFDYWGQGTLVTVSS
ASTGGGGSGGGGSGGGGSGGGGSSYELTQDPAVSVALGQTVRITCQGDSLRSYYASWY
QQKPGQAPVLVIYGKNNRPSGIPDRFSGSTSGNSASLTITGAQAEDEADYYCNSRDSSGN
HWVFGGGTKVTVLG
(SEQ ID NO: 210)

SF-G1-P1

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL
LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGGGGGSGGGGSGGGGSEVQLVESG
GGLVQPGRSLRLSCAASGFTFDDYAMHWVRQAPGKGLEWVSGISWDSGSTGYADSVK
GRFTISRDNAKNSLYLQMNSLRAEDTALYYCARDLGAYQWVEGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCESRDSPGNQWVFG
GGTKVTVLG
(SEQ ID NO: 212)

SF-G1-M1.3

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL
LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGGGGGSGGGGSGGGGSQVQLVQSG
GGLVQPGGSLRLSCAASGFTFDDYAMHWVRQAPGKGLEWVAGISWDSGSTGYADSVK
GRFTISRDNAKNSLYLQMNSLRAEDTALYYCARDLGAYQWVEGFDYWGQGTLVTVSS
ASTGGGGSGGGGSGGGGSGGGGSSYELTQDPAVSVALGQTVRITCQGDSLRSYYASWY
QQKPGQAPVLVIYGKNNRPSGIPDRFSGSTSGNSASLTITGAQAEDEADYYCNSRDSPGN
QWVFGGGTKVTVLG
(SEQ ID NO: 214)

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL
LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGGGGGSGGGGSGGGGSEVQLVESG
GGLVQPGRSLRLSCAASGFTFDDYAMHWVRQAPGKGLEWVSGISWNSGSTGYADSVK
GRFTISRDNAKNSLYLQMNSLRAEDTALYYCARDLGFNQWVDGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCNSRDTPGDQWVFG
GGTKVTVLG
(SEQ ID NO: 216)

SF-G1-P6

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL
LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGGGGGSGGGGSGGGGSEVQLVESG
GGLVQPGRSLRLSCAASGFTFDDYAMHWVRQAPGKGLEWVSGISWNSGSTGYADSVK
GRFTISRDNAKNSLYLQMNSLRAEDTALYYCARDLGYNQWLEGFDYWGQGTLVTVSSA
STGGGGSGGGGSGGGGSSSELTQDPAVSVALGQTVRITCQGDSLRSYYASWYQQKPGQ
APVLVIYGKNNRPSGIPDRFSGSSSGNTASLTITGAQAEDEADYYCMSRDHPGNQWVFG
GGTKVTVLG
(SEQ ID NO: 218)

SF-G1-B69

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL
LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGGGGGSGGGGSGGGGSEVQLVESG
GGLVQPGRSLRLSCAASGFTFDDYAMHWVRQAPGKGLEWVSGISWNSGSVGYADSVK
GRFTISRDNAKNSLYLQMNSLRAEDTALYYCARDLGYNQWLEGFDYWGQGTLVTVSSA
STGGGGSGGGGSGGGGSSSELTQDPAVSVALGQTVRITCQGDSLRSYYASWYQQKPGQ
APVLVIYGKNNRPSGIPDRFSGSSSGNTASLTITGAQAEDEADYYCMSRDSPGNQWVFGG
GTKVTVLG
(SEQ ID NO: 220)

EVQLLQSGGGLVQPGGSLRLSCAASGFMFSRYPMHWVRQAPGKGLEWVGSISGSGGAT
PYADSVKGRFTISRDNSKNTLYLQMNSLRAEDTAVYYCAKDFYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGGGGSGGGGSGGGGSQVQLV
QSGGGLVQPGGSLRLSCAASGFTFDDYAMHWVRQAPGKGLEWVAGISWNSGSIGYADS
VKGRFTISRDNAKNSLYLQMNSLRPEDTAVYYCARDLGYNQWVEGFDYWGQGTLVTV
SSASTGGGGSGGGGSGGGGSGGGGSSYELTQDPAVSVALGQTVRITCQGDSLRSYYAS
WYQQKPGQAPVLVIYGKNNRPSGIPDRFSGSTSGNSASLTITGAQAEDEADYYCNSRDSS
GNHWVFGGGTKVTVLG
(SEQ ID NO: 222)

P4-G1-P1

EVQLLQSGGGLVQPGGSLRLSCAASGFMFSRYPMHWVRQAPGKGLEWVGSISGSGGAT
PYADSVKGRFTISRDNSKNTLYLQMNSLRAEDTAVYYCAKDFYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGGGGSGGGGSGGGGSEVQLVE
SGGGLVQPGRSLRLSCAASGFTFDDYAMHWVRQAPGKGLEWVSGISWDSGSTGYADSV
KGRFTISRDNAKNSLYLQMNSLRAEDTALYYCARDLGAYQWVEGFDYWGQGTLVTVS
SASTGGGGSGGGGSGGGGSSELTQDPAVSVALGQTVRITCQGDSLRSYYASWYQQKP
GQAPVLVIYGKNNRPSGIPDRFSGSSSGNTASLTITGAQAEDEADYYCESRDSPGNQWVF
GGGTKVTVLG
(SEQ ID NO: 224)

P4-G1-M1.3

EVQLLQSGGGLVQPGGSLRLSCAASGFMFSRYPMHWVRQAPGKGLEWVGSISGSGGAT
PYADSVKGRFTISRDNSKNTLYLQMNSLRAEDTAVYYCAKDFYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGGGGSGGGGSGGGGSQVQLV
QSGGGLVQPGGSLRLSCAASGFTFDDYAMHWVRQAPGKGLEWVAGISWDSGSTGYAD
SVKGRFTISRDNAKNSLYLQMNSLRAEDTALYYCARDLGAYQWVEGFDYWGQGTLVT
VSSASTGGGGSGGGGSGGGGSGGGGSSYELTQDPAVSVALGQTVRITCQGDSLRSYYAS
WYQQKPGQAPVLVIYGKNNRPSGIPDRFSGSTSGNSASLTITGAQAEDEADYYCNSRDSP
GNQWVFGGGTKVTVLG

*Fig. 5A (cont.)*

(SEQ ID NO: 226)

P4-G1-M27

EVQLLQSGGGLVQPGGSLRLSCAASGEMFSRYPMHWVRQAPGKGLEWVGSISGSGGAT
PYADSVKGRFTISRDNSKNTLYLQMNSLRAEDTAVYYCAKDEYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGGGGSGGGGSGGGGSEVQLVE
SGGGLVQPGRSLRLSCAASGFTFDDYAMHWVRQAPGKGLEWVSGISWNSGSTGYADSV
KGRFTISRDNAKNSLYLQMNSLRAEDTALYYCARDLGFNQWVDGFDYWGQGTLVTVS
SASTGGGGSGGGGSGGGGSSSELTQDPAVSVALGQTVRITCQGDSLRSYYASWYQQKP
GQAPVLVIYGKNNRPSGIPDRFSGSSSGNTASLTITGAQAEDEADYYCNSRDTPGDQWVF
GGGTKVTVLG
(SEQ ID NO: 228)

P4-G1-P6

EVQLLQSGGGLVQPGGSLRLSCAASGEMFSRYPMHWVRQAPGKGLEWVGSISGSGGAT
PYADSVKGRFTISRDNSKNTLYLQMNSLRAEDTAVYYCAKDEYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGGGGSGGGGSGGGGSEVQLVE
SGGGLVQPGRSLRLSCAASGFTFDDYAMHWVRQAPGKGLEWVSGISWNSGSTGYADSV
KGRFTISRDNAKNSLYLQMNSLRAEDTALYYCARDLGYNQWLEGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCMSRDHPGNQWVF
GGGTKVTVLG
(SEQ ID NO: 230)

P4-G1-B69

EVQLLQSGGGLVQPGGSLRLSCAASGEMFSRYPMHWVRQAPGKGLEWVGSISGSGGAT
PYADSVKGRFTISRDNSKNTLYLQMNSLRAEDTAVYYCAKDEYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGGGGSGGGGSGGGGSEVQLVE
SGGGLVQPGRSLRLSCAASGFTFDDYAMHWVRQAPGKGLEWVSGISWNSGSVGYADS
VKGRFTISRDNAKNSLYLQMNSLRAEDTALYYCARDLGYNQWLEGFDYWGQGTLVTV
SSASTGGGGSGGGGSGGGGSSSELTQDPAVSVALGQTVRITCQGDSLRSYYASWYQQKP

Fig. 5A (cont.)

GQAPVLVIYGKNNRPSGIPDRFSGSSSGNTASLTITGAQAEDEADYYCMSRDSPGNQWVF
GGGTKVTVLG
(SEQ ID NO: 232)

M78-G1-C8

EVQLLQSGGGLVQPGGSLRLSCAASGFDESSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGSGGGGSGGGGSQVQLVQ
SGGGLVQPGGSLRLSCAASGFTFDDYAMHWVRQAPGKGLEWVAGISWNSGSIGYADSV
KGRFTISRDNAKNSLYLQMNSLRPEDTAVYYCARDLGYNQWVEGFDYWGQGTLVTVS
SASTGGGGSGGGGSGGGGSGGGGSSYELTQDPAVSVALGQTVRITCQGDSLRSYYASW
YQQKPGQAPVLVIYGKNNRPSGIPDRFSGSTSGNSASLTITGAQAEDEADYYCNSRDSSG
NHWVFGGGTKVTVLG
(SEQ ID NO: 234)

M78-G1-P1

EVQLLQSGGGLVQPGGSLRLSCAASGFDESSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGSGGGGSGGGGSEVQLVES
GGGLVQPGRSLRLSCAASGFTFDDYAMHWVRQAPGKGLEWVSGISWDSGSTGYADSV
KGRFTISRDNAKNSLYLQMNSLRAEDTALYYCARDLGAYQWVEGFDYWGQGTLVTVS
SASTGGGGSGGGGSGGGGSSSELTQDPAVSVALGQTVRITCQGDSLRSYYASWYQQKP
GQAPVLVIYGKNNRPSGIPDRFSGSSSGNTASLTITGAQAEDEADYYCESRDSPGNQWVF
GGGTKVTVLG
(SEQ ID NO: 236)

M78-G1-M1.3

EVQLLQSGGGLVQPGGSLRLSCAASGFDESSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGSGGGGSGGGGSQVQLVQ
SGGGLVQPGGSLRLSCAASGFTFDDYAMHWVRQAPGKGLEWVAGISWDSGSTGYADS

*Fig. 5A (cont.)*

VKGRFTISRDNAKNSLYLQMNSLRAEDTALYYCARDLGAYQWVEGFDYWGQGTLVTV
SSASTGGGGSGGGGSGGGGSGGGGSSYELTQDPAVSVALGQTVRITCQGDSLRSYYAS
WYQQKPGQAPVLVIYGKNNRPSGIPDRFSGSTSGNSASLTITGAQAEDEADYYCNSRDSP
GNQWVFGGGTKVTVLG
(SEQ ID NO: 238)

M78-G1-M27

EVQLLQSGGGLVQPGGSLRLSCAASGFDFSSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGSGGGGSGGGGSEVQLVES
GGGLVQPGRSLRLSCAASGFTFDDYAMHWVRQAPGKGLEWVSGISWNSGSTGYADSV
KGRFTISRDNAKNSLYLQMNSLRAEDTALYYCARDLGFNQWVDGFDYWGQGTLVTVS
SASTGGGGSGGGGSGGGGSSSELTQDPAVSVALGQTVRITCQGDSLRSYYASWYQQKP
GQAPVLVIYGKNNRPSGIPDRFSGSSSGNTASLTITGAQAEDEADYYCNSRDTPGDQWVF
GGGTKVTVLG
(SEQ ID NO: 240)

M78-G1-P6

EVQLLQSGGGLVQPGGSLRLSCAASGFDFSSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGSGGGGSGGGGSEVQLVES
GGGLVQPGRSLRLSCAASGFTFDDYAMHWVRQAPGKGLEWVSGISWNSGSTGYADSV
KGRFTISRDNAKNSLYLQMNSLRAEDTALYYCARDLGYNQWLEGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCMSRDHPGNQWVF
GGGTKVTVLG
(SEQ ID NO: 242)

M78-G1-B69

EVQLLQSGGGLVQPGGSLRLSCAASGFDFSSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP

*Fig. 5A (cont.)*

REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSEVQLVES
GGGLVQPGRSLRLSCAASGFTFDDYAMHWVRQAPGKGLEWVSGISWNSGSVGYADSV
KGRFTISRDNAKNSLYLQMNSLRAEDTALYYCARDLGYNQWLEGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCMSRDSPGNQWVFG
GGTKVTVLG
(SEQ ID NO: 244)

M57-G1-C8

EVQLLQSGGGLVQPGGSLRLSCAASGFFFSKYPMHWVRQAPGKGLEWVSSISSDGGATV
YADSVKGRFTISRDNSKNTLYLQMNSLRAEDTAVYYCAKDFYTWLTGNAFDSWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSQVQLVQ
SGGGLVQPGGSLRLSCAASGFTFDDYAMHWVRQAPGKGLEWVAGISWNSGSIGYADSV
KGRFTISRDNAKNSLYLQMNSLRPEDTAVYYCARDLGYNQWVEGFDYWGQGTLVTVS
SASTGGGGSGGGGSGGGGSGGGGSSYELTQDPAVSVALGQTVRITCQGDSLRSYYASW
YQQKPGQAPVLVIYGKNNRPSGIPDRFSGSTSGNSASLTITGAQAEDEADYYCNSRDSSG
NHWVFGGGTKVTVLG
(SEQ ID NO: 246)

M57-G1-P1

EVQLLQSGGGLVQPGGSLRLSCAASGFFFSKYPMHWVRQAPGKGLEWVSSISSDGGATV
YADSVKGRFTISRDNSKNTLYLQMNSLRAEDTAVYYCAKDFYTWLTGNAFDSWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSEVQLVES
GGGLVQPGRSLRLSCAASGFTFDDYAMHWVRQAPGKGLEWVSGISWDSGSTGYADSV
KGRFTISRDNAKNSLYLQMNSLRAEDTALYYCARDLGAYQWVEGFDYWGQGTLVTVS
SASTGGGGSGGGGSGGGGSSSELTQDPAVSVALGQTVRITCQGDSLRSYYASWYQQKP
GQAPVLVIYGKNNRPSGIPDRFSGSSSGNTASLTITGAQAEDEADYYCESRDSPGNQWVF
GGGTKVTVLG
(SEQ ID NO: 248)

M57-G1-M1.3

EVQLLQSGGGLVQPGGSLRLSCAASGFFFSKYPMHWVRQAPGKGLEWVSSISSDGGATV
YADSVKGRFTISRDNSKNTLYLQMNSLRAEDTAVYYCAKDFYTWLTGNAFDSWGQGTS

Fig. 5A (cont.)

VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSQVQLVQ
SGGGLVQPGGSLRLSCAASGFTFDDYAMHWVRQAPGKGLEWVAGISWDSGSTGYADS
VKGRFTISRDNAKNSLYLQMNSLRAEDTALYYCARDLGAYQWVEGFDYWGQGTLVTV
SSASTGGGGSGGGGSGGGGSGGGGSSYELTQDPAVSVALGQTVRITCQGDSLRSYYAS
WYQQKPGQAPVLVIYGKNNRPSGIPDRFSGSTSGNSASLTITGAQAEDEADYYCNSRDSP
GNQWVFGGGTKVTVLG
(SEQ ID NO: 250)

M57-G1-M27

EVQLLQSGGGLVQPGGSLRLSCAASGFFFSKYPMHWVRQAPGKGLEWVSSISSDGGATY
YADSVKGRFTISRDNSKNTLYLQMNSLRAEDTAVYYCAKDFYTWLTGNAFDSWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSEVQLVES
GGGLVQPGRSLRLSCAASGFTFDDYAMHWVRQAPGKGLEWVSGISWNSGSTGYADSV
KGRFTISRDNAKNSLYLQMNSLRAEDTALYYCARDLGFNQWVDGFDYWGQGTLVTVS
SASTGGGGSGGGGSGGGGSSSELTQDPAVSVALGQTVRITCQGDSLRSYYASWYQQKP
GQAPVLVIYGKNNRPSGIPDRFSGSSSGNTASLTITGAQAEDEADYYCNSRDTPGDQWVF
GGGTKVTVLG
(SEQ ID NO: 252)

M57-G1-P6

EVQLLQSGGGLVQPGGSLRLSCAASGFFFSKYPMHWVRQAPGKGLEWVSSISSDGGATY
YADSVKGRFTISRDNSKNTLYLQMNSLRAEDTAVYYCAKDFYTWLTGNAFDSWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSEVQLVES
GGGLVQPGRSLRLSCAASGFTFDDYAMHWVRQAPGKGLEWVSGISWNSGSTGYADSV
KGRFTISRDNAKNSLYLQMNSLRAEDTALYYCARDLGYNQWLEGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCMSRDHPGNQWVF
GGGTKVTVLG
(SEQ ID NO: 254)

EVQLLQSGGGLVQPGGSLRLSCAASGFFFSKYPMHWVRQAPGKGLEWVSSISSDGGATV
YADSVKGRFTISRDNSKNTLYLQMNSLRAEDTAVYYCAKDFYTWLTGNAFDSWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGGGGGSGGGGSGGGGSEVQLVES
GGGLVQPGRSLRLSCAASGFTFDDYAMHWVRQAPGKGLEWVSGISWNSGSVGYADSV
KGRFTISRDNAKNSLYLQMNSLRAEDTALYYCARDLGYNQWLEGFDYWGQGTLVTVSS
ASTGGGGSGGGGSGGGGSSSELTQDPAVSVALGQTVRITCQGDSLRSYYASWYQQKPG
QAPVLVIYGKNNRPSGIPDRFSGSSSGNTASLTITGAQAEDEADYYCMSRDSPGNQWVFG
GGTKVTVLG
(SEQ ID NO: 256)

Fig. 5A *(cont.)*

Anti-ErbB3-IgG1/anti-IGF1R BISPECIFICS

LIGHT CHAINS

P1 LAMBDA LIGHT CHAIN

SSELTQDPAVSVALGQTVRITCQGDSLRSYYASWYQQKPGQAPVLVIYGKNNRPSGIPDR
FSGSSSGNTASLTITGAQAEDEADYYCESRDSPGNQWVFGGGTKVTVLGQPKAAPSVTL
FPPSSEELQANKATLVCLVSDFYPGAVTVAWKADGSPVKVGVETTKPSKQSNNKYAASS
YLSLTPEQWKSHRSYSCRVTHEGSTVEKTVAPAECS
(SEQ ID NO: 258)

M27 LAMBDA LIGHT CHAIN

SSELTQDPAVSVALGQTVRITCQGDSLRSYYASWYQQKPGQAPVLVIYGKNNRPSGIPDR
FSGSSSGNTASLTITGAQAEDEADYYCNSRDTPGDQWVFGGGTKVTVLGQPKAAPSVTL
FPPSSEELQANKATLVCLVSDFYPGAVTVAWKADGSPVKVGVETTKPSKQSNNKYAASS
YLSLTPEQWKSHRSYSCRVTHEGSTVEKTVAPAECS
(SEQ ID NO: 260)

M7 LAMBDA LIGHT CHAIN

SSELTQDPAVSVALGQTVRITCQGDSLRSYYASWYQQKPGQAPVLVIYGKNNRPSGIPDR
FSGSSSGNTASLTITGAQAEDEADYYCNSRDTPGNKWVFGGGTKVTVIGQPKAAPSVTL
FPPSSEELQANKATLVCLVSDFYPGAVTVAWKADGSPVKVGVETTKPSKQSNNKYAASS
YLSLTPEQWKSHRSYSCRVTHEGSTVEKTVAPAECS
(SEQ ID NO: 262)

B72 LAMBDA LIGHT CHAIN

SSELTQDPAVSVALGQTVRITCQGDSLRSYYASWYQQKPGQAPVLVIYGKNNRPSGIPDR
FSGSSSGNTASLTITGAQAEDEADYYCNSRDVPGDQWVFGGGTKVTVLGQPKAAPSVTL
FPPSSEELQANKATLVCLVSDFYPGAVTVAWKADGSPVKVGVETTKPSKQSNNKYAASS
YLSLTPEQWKSHRSYSCRVTHEGSTVEKTVAPAECS
(SEQ ID NO: 264)

B60 LAMBDA LIGHT CHAIN

SSELTQDPAVSVALGQTVRITCQGDSLRSYYASWYQQKPGQAPVLVIYGKNNRPSGIPDR
FSGSSSGNTASLTITGAQAEDEADYYCNSRDWPGNQWVFGGGTKVTVLGQPKAAPSVT
LFPPSSEELQANKATLVCLVSDFYPGAVTVAWKADGSPVKVGVETTKPSKQSNNKYAAS
SYLSLTPEQWKSHRSYSCRVTHEGSTVEKTVAPAECS
(SEQ ID NO: 266)

*Fig. 5B*

HEAVY CHAINS

P1-G1-P4

EVQLVESGGGLVQPGRSLRLSCAASGFTFDDYAMHWVRQAPGKGLEWVSGISWDSGST
GYADSVKGRFTISRDNAKNSLYLQMNSLRAEDTALYYCARDLGAYQWVEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFMFSRYPMHWVRQAPGKGLEWVGSISGSGGATPYADS
VKGRFTISRDNSKNTLYLQMNSLRAEDTAVYYCAKDFYQILTGNAFDYWGQGTTVTVS
SASTGGGGSGGGGSGGGGSGGGGSDIQMTQSPSSLSASLGDRVTITCRASQGISSYLAWY
QQKPGKAPKLLIYAKSTLQSGVPSRFSGSGSGTDFTLTISSLQPEDSATYYCQQYWTPLT
FGGGTKVEIKRT
(SEQ ID NO: 268)

P1-G1-M57

EVQLVESGGGLVQPGRSLRLSCAASGFTFDDYAMHWVRQAPGKGLEWVSGISWDSGST
GYADSVKGRFTISRDNAKNSLYLQMNSLRAEDTALYYCARDLGAYQWVEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFFFSKYPMHWVRQAPGKGLEWVSSISSDGGATVYADS
VKGRFTISRDNSKNTLYLQMNSLRAEDTAVYYCAKDFYTWLTGNAEDSWGQGTSVTVS
SASTGGGGSGGGGSGGGGSGGGGSDIQLTQSPSSLSASLGDRVTITCRASQGISSYLAWY
QQKPGKAPKLLIYARSTRQSGVPSRFSGSGSGTEFTLTISSLQPEDSATYYCQQYWTWPL
TFGGGTKVEIKRT
(SEQ ID NO: 270)

P1-G1-M78

EVQLVESGGGLVQPGRSLRLSCAASGFTFDDYAMHWVRQAPGKGLEWVSGISWDSGST
GYADSVKGRFTISRDNAKNSLYLQMNSLRAEDTALYYCARDLGAYQWVEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFDFSSYPMHWVRQAPGKGLEWVGSISSSGGATPYADSV
KGRFTISRDNSKNTLYLQMNSLRPEDTAVYYCAKDFYTILTGNAFDMWGQGTSVTVSSA

*Fig. 5B (cont.)*

STGGGGSGGGGSGGGGSGGGGSDIQMTQSPSSLSASLGDRVTITCRASQGISSYLAWYQ
QKPGKAPKLLIYASSTRQSGVPSRFSGSGSGTDFTLTISSLQPEDSGTYYCQQYWAFPLTF
GGGTKVEIKRT
(SEQ ID NO: 272)

M27-G1-P4

EVQLVESGGGLVQPGRSLRLSCAASGFTFDDYAMHWVRQAPGKGLEWVSGISWNSGST
GYADSVKGRFTISRDNAKNSLYLQMNSLRAEDTALYYCARDLGFNQWVDGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGSGGGGSGGGGSEVQLL
QSGGGLVQPGGSLRLSCAASGFMFSRYPMHWVRQAPGKGLEWVGSISGSGGATPYADS
VKGRFTISRDNSKNTLYLQMNSLRAEDTAVYYCAKDFYQILTGNAFDYWGQGTTVTVS
SASTGGGGSGGGGSGGGGSGGGGSDIQMTQSPSSLSASLGDRVTITCRASQGISSYLAWY
QQKPGKAPKLLIYAKSTLQSGVPSRFSGSGSGTDFTLTISSLQPEDSATYYCQQYWTFPLT
FGGGTKVEIKRT
(SEQ ID NO: 274)

M27-G1-M57

EVQLVESGGGLVQPGRSLRLSCAASGFTFDDYAMHWVRQAPGKGLEWVSGISWNSGST
GYADSVKGRFTISRDNAKNSLYLQMNSLRAEDTALYYCARDLGFNQWVDGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGSGGGGSGGGGSEVQLL
QSGGGLVQPGGSLRLSCAASGFFFSKYPMHWVRQAPGKGLEWVSSISSDGGATVYADS
VKGRFTISRDNSKNTLYLQMNSLRAEDTAVYYCAKDEXTWLTGNAEDSWGQGTSVTVS
SASTGGGGSGGGGSGGGGSGGGGSDIQLTQSPSSLSASLGDRVTITCRASQGISSYLAWY
QQKPGKAPKLLIYARSTRQSGVPSRFSGSGSGTEFTLTISSLQPEDSATYYCQQYWTWPL
TFGGGTKVEIKRT
(SEQ ID NO: 276)

M27-G1-M78

EVQLVESGGGLVQPGRSLRLSCAASGFTFDDYAMHWVRQAPGKGLEWVSGISWNSGST
GYADSVKGRFTISRDNAKNSLYLQMNSLRAEDTALYYCARDLGFNQWVDGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV

Fig. 5B (cont.)

YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFDFSSYPMHWVRQAPGKGLEWVGSISSSGGATPYADSV
KGRFTISRDNSKNTLYLQMNSLRPEDTAVYYCAKDFYTILTGNAFDMWGQGTSVTVSSA
STGGGGSGGGGSGGGGSGGGGSDIQMTQSPSSLSASLGDRVTITCRASQGISSYLAWYQ
QKPGKAPKLLIYASSTRQSGVPSRFSGSGSGTDFTLTISSLQPEDSGTYYCQQYWAFPLTF
GGGTKVEIKRT
(SEQ ID NO: 278)

M7-G1-P4

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGYNQWWEGFDYWGQ
GTLVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFMFSRYPMHWVRQAPGKGLEWVGSISGSGGATPYADS
VKGRFTISRDNSKNTLYLQMNSLRAEDTAVYYCAKDFYQILTGNAEDYWGQGTTVTVS
SASTGGGGSGGGGSGGGGSGGGGSDIQMTQSPSSLSASLGDRVTITCRASQGISSYLAWY
QQKPGKAPKLLIYAKSTLQSGVPSRFSGSGSGTDFTLTISSLQPEDSATYYCQQYWTFPLT
FGGGTKVEIKRT
(SEQ ID NO: 280)

M7-G1-M57

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGYNQWWEGFDYWGQ
GTLVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFFFSKYPMHWVRQAPGKGLEWVSSISSDGGATVYADS
VKGRFTISRDNSKNTLYLQMNSLRAEDTAVYYCAKDFYTWLTGNAFDSWGQGTSVTVS
SASTGGGGSGGGGSGGGGSGGGGSDIQLTQSPSSLSASLGDRVTITCRASQGISSYLAWY
QQKPGKAPKLLIYARSTRQSGVPSRFSGSGSGTEFTLTISSLQPEDSATYYCQQYWTWPL
TFGGGTKVEIKRT
(SEQ ID NO: 282)

M7-G1-M78

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGYNQWWEGFDYWGQ

*Fig. 5B (cont.)*

GTLVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFDFSSYPMHWVRQAPGKGLEWVGSISSSGGATPYADSV
KGRFTISRDNSKNTLYLQMNSLRPEDTAVYYCAKDFYTILTGNAFDMWGQGTSVTVSSA
STGGGGSGGGGSGGGGSGGGGSDIQMTQSPSSLSASLGDRVTITCRASQGISSYLAWYQ
QKPGKAPKLLIYASSTRQSGVPSRFSGSGSGTDFTLTISSLQPEDSGTYYCQQYWAFPLTF
GGGTKVEIKRT
(SEQ ID NO: 284)

B72-G1-P4

EVQLVESGGGLVQPGRSLRLSCAASGFTFDDYAMHWVRQAPGKGLEWVSGISWNSGSR
GYADSVKGRFTISRDNAKNSLYLQMNSLRAEDTALYYCARDLGFNQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFMFSRYPMHWVRQAPGKGLEWVGSISGSGGATPYADS
VKGRFTISRDNSKNTLYLQMNSLRAEDTAVYYCAKDFYQILTGNAFDYWGQGTTVTVS
SASTGGGGSGGGGSGGGGSGGGGSDIQMTQSPSSLSASLGDRVTITCRASQGISSYLAWY
QQKPGKAPKLLIYAKSTLQSGVPSRFSGSGSGTDFTLTISSLQPEDSATYYCQQYWTFPLT
FGGGTKVEIKRT
(SEQ ID NO: 286)

B72-G1-M57

EVQLVESGGGLVQPGRSLRLSCAASGFTFDDYAMHWVRQAPGKGLEWVSGISWNSGSR
GYADSVKGRFTISRDNAKNSLYLQMNSLRAEDTALYYCARDLGFNQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFFFSKYPMHWVRQAPGKGLEWVSSISSDGGATYYADS
VKGRFTISRDNSKNTLYLQMNSLRAEDTAVYYCAKDFYTWLTGNAFDSWGQGTSVTVS
SASTGGGGSGGGGSGGGGSGGGGSDIQLTQSPSSLSASLGDRVTITCRASQGISSYLAWY
QQKPGKAPKLLIYARSTRQSGVPSRFSGSGSGTEFTLTISSLQPEDSATYYCQQYWTWPL
TFGGGTKVEIKRT
(SEQ ID NO: 288)

EVQLVESGGGLVQPGRSLRLSCAASGFTEDDYAMHWVRQAPGKGLEWVSGISWNSGSR
GYADSVKGRFTISRDNAKNSLYLQMNSLRAEDTALYYCARDLGFNQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFDFSSYPMHWVRQAPGKGLEWVGSISSSGGATPYADSV
KGRFTISRDNSKNTLYLQMNSLRPEDTAVYYCAKDFYTILIGNAFDMWGQGTSVTVSSA
STGGGGSGGGGSGGGGSGGGGSDIQMTQSPSSLSASLGDRVTITCRASQGISSYLAWYQ
QKPGKAPKLLIYASSTRQSGVPSRFSGSGSGTDFTLTISSLQPEDSGTYYCQQYWAFPLTF
GGGTKVEIKRT
(SEQ ID NO: 290)

B60-G1-P4

EVQLVESGGGLVQPGRSLRLSCAASGFTEDDYAMHWVRQAPGKGLEWVSGISWDSGSV
GYADSVKGRFTISRDNAKNSLYLQMNSLRAEDTALYYCARDLGAYQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFMFSRYPMHWVRQAPGKGLEWVGSISGSGGATPYADS
VKGRFTISRDNSKNTLYLQMNSLRAEDTAVYYCAKDFXQILTGNAFDYWGQGTTVTVS
SASTGGGGSGGGGSGGGGSGGGGSDIQMTQSPSSLSASLGDRVTITCRASQGISSYLAWY
QQKPGKAPKLLIYAKSTLQSGVPSRFSGSGSGTDFTLTISSLQPEDSATYYCQQYWTFPLT
FGGGTKVEIKRT
(SEQ ID NO: 292)

B60-G1-M57

EVQLVESGGGLVQPGRSLRLSCAASGFTEDDYAMHWVRQAPGKGLEWVSGISWDSGSV
GYADSVKGRFTISRDNAKNSLYLQMNSLRAEDTALYYCARDLGAYQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGGSGGGGSGGGGSEVQLL
QSGGGLVQPGGSLRLSCAASGFFFSKYPMHWVRQAPGKGLEWVSSISSDGGATVYADS
VKGRFTISRDNSKNTLYLQMNSLRAEDTAVYYCAKDFXTWLTGNAFDSWGQGTSVTVS
SASTGGGGSGGGGSGGGGSGGGGSDIQLTQSPSSLSASLGDRVTITCRASQGISSYLAWY

*Fig. 5B (cont.)*

QQKPGKAPKLLIYARSTRQSGVPSRFSGSGSGTEFTLTISSLQPEDSATYYCQQYWTWPL
TFGGGTKVEIKRT
(SEQ ID NO: 294)

B60-G1-M78

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGAYQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGGGGSGGGGSGGGGSEVQLL
QSGGGLVQPGGSLRLSCAASGFDFSSYPMHWVRQAPGKGLEWVGSISSSGGATPYADSV
KGRFTISRDNSKNTLYLQMNSLRPEDTAVYYCAKDFYTILTGNAFDMWGQGTSVTVSSA
STGGGGSGGGGSGGGGSGGGGSDIQMTQSPSSLSASLGDRVTITCRASQGISSYLAWYQ
QKPGKAPKLLIYASSTRQSGVPSRFSGSGSGTDFTLTISSLQPEDSGTYYCQQYWAFPLTF
GGGTKVEIKRT
(SEQ ID NO: 296)

B60-G2-M78 (IgG2 backbone)

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGAYQWEEGFDYWGQG
TLVTVSSASTKGPSVFPLAPCSRSTSESTAALGCLVKDYFPEPVTVSWNSGALTSGVHTFP
AVLQSSGLYSLSSVVTVPSSNFGTQTYTCNVDHKPSNTKVDKTVERKCCVECPPCPAPPV
AGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPPS
REEMTKNQVSLTCLVKGFYPSDIAVEWESNGQPENNYKTTPPMLDSDGSFFLYSKLTVD
KSRWQQGNVFSCSVMHEALHNHYTQKSLSLSPGGGGSGGGGSGGGGSEVQLLQSGG
GLVQPGGSLRLSCAASGFDFSSYPMHWVRQAPGKGLEWVGSISSSGGATPYADSVKGRF
TISRDNSKNTLYLQMNSLRPEDTAVYYCAKDFYTILTGNAFDMWGQGTSVTVSSASTGG
GGSGGGGSGGGGSDIQMTQSPSSLSASLGDRVTITCRASQGISSYLAWYQQKPG
KAPKLLIYASSTRQSGVPSRFSGSGSGTDFTLTISSLQPEDSGTYYCQQYWAFPLTFGGGT
KVEIKRT
(SEQ ID NO: 355)

M7-G2-M78 (IgG2 back bone)

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGYNQWEGFDYWGQ
GTLVTVSSASTKGPSVFPLAPCSRSTSESTAALGCLVKDYFPEPVTVSWNSGALTSGVHT
FPAVLQSSGLYSLSSVVTVPSSNFGTQTYTCNVDHKPSNTKVDKTVERKCCVECPPCPAP
PVAGPSVFLFPPKPKDTLMISRTPEVTCVVVDVSHEDPEVQFNWYVDGVEVHNAKTKPR
EEQFNSTFRVVSVLTVVHQDWLNGKEYKCKVSNKGLPAPIEKTISKTKGQPREPQVYTLP
PSREEMTKNQVSLTCLVKGFYPSDIAVEWESNGQPENNYKTTPPMLDSDGSFFLYSKLTV

*Fig. 5B (cont.)*

DKSRWQQGNVFSCSVMHEALHNHYTQKSLSLSPGGGGGSGGGGSGGGGSEVQLLQSG
GGLVQPGGSLRLSCAASGFDFSSYPMHWVRQAPGKGLEWVGSISSSGGATPYADSVKG
RFTISRDNSKNTLYLQMNSLRPEDTAVYYCAKDFYTILTGNAFDMWGQGTSVTVSSAST
GGGGSGGGGSGGGGSGGGGSDIQMTQSPSSLSASLGDRVTITCRASQGISSYLAWYQQK
PGKAPKLLIYASSTRQSGVPSRFSGSGSGTDFTLTISSLQPEDSGTYYCQQYWAFPLTFGG
GTKVEIKRT (SEQ ID NO: 357)

*Fig. 5B (cont.)*

Anti-IGF-1R-IgG1 Heavy Chains

SF IgG1

EVQLLQSGGGLVQPGGSLRLSCAASGFTFSVYPMHWVRQAPGKGLEWVSSISSSGGATR
YADSVKGRFTISRDNSKNTLYLQMNSLRAEDTAVYYCAKDFYDILTGNAFDIWGQGTTV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEL
LGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTV
DKSRWQQGNVFSCSVMHEALHNHYTQKSLSLSPG
(SEQ ID NO: 358)

P4 IgG1

EVQLLQSGGGLVQPGGSLRLSCAASGFMFSRYPMHWVRQAPGKGLEWVGSISGSGGAT
PYADSVKGRFTISRDNSKNTLYLQMNSLRAEDTAVYYCAKDFYQILTGNAFDYWGQGT
TVTVSSASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPG
(SEQ ID NO:359)

M78 IgG1

EVQLLQSGGGLVQPGGSLRLSCAASGFDFSSYPMHWVRQAPGKGLEWVGSISSSGGATP
YADSVKGRFTISRDNSKNTLYLQMNSLRPEDTAVYYCAKDEYTILTGNAFDMWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPG
(SEQ ID NO:360)

M57 IgG1

EVQLLQSGGGLVQPGGSLRLSCAASGFFFSKYPMHWVRQAPGKGLEWVSSISSDGGATV
YADSVKGRFTISRDNSKNTLYLQMNSLRAEDTAVYYCAKDEYTWLTGNAFDSWGQGTS
VTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAP
ELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPG
(SEQ ID NO:361)

*Fig. 6A*

Anti-ErbB3-IgG Heavy Chains

P1

EVQLVESGGGLVQPGRSLRLSCAASGFTFDDYAMHWVRQAPGKGLEWVSGISWDSGST
GYADSVKGRFTISRDNAKNSLYLQMNSLRAEDTALYYCARDLGAYQWVEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPG
(SEQ ID NO:362)

M27

EVQLVESGGGLVQPGRSLRLSCAASGFTFDDYAMHWVRQAPGKGLEWVSGISWNSGST
GYADSVKGRFTISRDNAKNSLYLQMNSLRAEDTALYYCARDLGFNQWVDGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPG
(SEQ ID NO:363)

M7

EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGYNQWWEGFDYWGQ
GTLVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPG
(SEQ ID NO:364)

B72

EVQLVESGGGLVQPGRSLRLSCAASGFTFDDYAMHWVRQAPGKGLEWVSGISWNSGSR
GYADSVKGRFTISRDNAKNSLYLQMNSLRAEDTALYYCARDLGFNQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV

*Fig. 6B*

YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPG
(SEQ ID NO:365)

B60
EVQLVESGGGLVQPGRSLRLSCAASGFTFDDYAMHWVRQAPGKGLEWVSGISWDSGSV
GYADSVKGRFTISRDNAKNSLYLQMNSLRAEDTALYYCARDLGAYQWEEGFDYWGQG
TLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCP
APELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPG
(SEQ ID NO:366)

*Fig. 6B (cont.)*

Anti-IGF-1R scFvs

P4

EVQLLQSGGGLVQPGGSLRLSCAASGFMFSRYPMHWVRQAPGKGLEWVGSISGSGGAT
PYADSVKGRFTISRDNSKNTLYLQMNSLRAEDTAVYYCAKDFYQILTGNAFDYWGQGT
TVTVSSASTGGGGSGGGGSGGGGSGGGGSDIQMTQSPSSLSASLGDRVTITCRASQGISS
YLAWYQQKPGKAPKLLIYAKSTLQSGVPSRFSGSGSGTDFTLTISSLQPEDSATYYCQQY
WTFPLTFGGGTKVEIKRT
(SEQ ID NO:367)

M57
EVQLLQSGGGLVQPGGSLRLSCAASGFFFSKYPMHWVRQAPGKGLEWVSSISSDGGATV
YADSVKGRFTISRDNSKNTLYLQMNSLRAEDTAVYYCAKDFYTWLTGNAFDSWGQGTS
VTVSSASTGGGGSGGGGSGGGGSGGGGSDIQLTQSPSSLSASLGDRVTITCRASQGISSYL
AWYQQKPGKAPKLLIYARSTRQSGVPSRFSGSGSGTEFTLTISSLQPEDSATYYCQQYWT
WPLTFGGGTKVEIKRT
(SEQ ID NO:368)

M78

EVQLLQSGGGLVQPGGSLRLSCAASGFDFSSYPMHWVRQAPGKGLEWVGSISSSGGATP
YADSVKGRFTISRDNSKNTLYLQMNSLRPEDTAVYYCAKDFYTILTGNAFDMWGQGTS
VTVSSASTGGGGSGGGGSGGGGSGGGGSDIQMTQSPSSLSASLGDRVTITCRASQGISSY
LAWYQQKPGKAPKLLIYASSTRQSGVPSRFSGSGSGTDFTLTISSLQPEDSGTYYCQQYW
AFPLTFGGGTKVEIKRT
(SEQ ID NO:369)

*Fig. 6C*

Anti-ErbB3 scFvs

C8

QVQLVQSGGGLVQPGGSLRLSCAASGFTFDDYAMHWVRQAPGKGLEWVAGISWNSGSI
GYADSVKGRFTISRDNAKNSLYLQMNSLRPEDTAVYYCARDLGYNQWVEGFDYWGQG
TLVTVSSASTGGGGSGGGGSGGGGSGGGGSSYELTQDPAVSVALGQTVRITCQGDSLRS
YYASWYQQKPGQAPVLVIYGKNNRPSGIPDRFSGSTSGNSASLTITGAQAEDEADYYCN
SRDSSGNHWVFGGGTKVTVLG
(SEQ ID NO:370)

P1

EVQLVESGGGLVQPGRSLRLSCAASGFTFDDYAMHWVRQAPGKGLEWVSGISWDSGSI
GYADSVKGRFTISRDNAKNSLYLQMNSLRAEDTALYYCARDLGAYQWVEGFDYWGQG
TLVTVSSASTGGGGSGGGGSGGGGSSSELTQDPAVSVALGQTVRITCQGDSLRSYYASW
YQQKPGQAPVLVIYGKNNRPSGIPDRFSGSSSGNTASLTITGAQAEDEADYYCESRDSPG
NQWVFGGGTKVTVLG
(SEQ ID NO:371)

M1.3

QVQLVQSGGGLVQPGGSLRLSCAASGFTFDDYAMHWVRQAPGKGLEWVAGISWDSGS
TGYADSVKGRFTISRDNAKNSLYLQMNSLRAEDTALYYCARDLGAYQWVEGFDYWGQ
GTLVTVSSASTGGGGSGGGGSGGGGSGGGGSSYELTQDPAVSVALGQTVRITCQGDSLR
SYYASWYQQKPGQAPVLVIYGKNNRPSGIPDRFSGSTSGNSASLTITGAQAEDEADYYC
NSRDSPGNQWVFGGGTKVTVLG
(SEQ ID NO:372)

M27

EVQLVESGGGLVQPGRSLRLSCAASGFTFDDYAMHWVRQAPGKGLEWVSGISWNSGSI
GYADSVKGRFTISRDNAKNSLYLQMNSLRAEDTALYYCARDLGFNQWVDGFDYWGQG
TLVTVSSASTGGGGSGGGGSGGGGSSSELTQDPAVSVALGQTVRITCQGDSLRSYYASW
YQQKPGQAPVLVIYGKNNRPSGIPDRFSGSSSGNTASLTITGAQAEDEADYYCNSRDTPG
DQWVFGGGTKVTVLG
(SEQ ID NO:373)

P6

EVQLVESGGGLVQPGRSLRLSCAASGFTFDDYAMHWVRQAPGKGLEWVSGISWNSGSI
GYADSVKGRFTISRDNAKNSLYLQMNSLRAEDTALYYCARDLGYNQWLEGFDYWGQG
TLVTVSSASTGGGGSGGGGSGGGGSSSELTQDPAVSVALGQTVRITCQGDSLRSYYASW
YQQKPGQAPVLVIYGKNNRPSGIPDRFSGSSSGNTASLTITGAQAEDEADYYCMSRDHPG
NQWVFGGGTKVTVLG
(SEQ ID NO:374)

EVQLVESGGGLVQPGRSLRLSCAASGFTFDDYAMHWVRQAPGKGLEWVSGISWNSGSV
GYADSVKGRFTISRDNAKNSLYLQMNSLRAEDTALYYCARDLGYNQWLEGFDYWGQG
TLVTVSSASTGGGGSGGGGSGGGGSSSELTQDPAVSVALGQTVRITCQGDSLRSYYASW
YQQKPGQAPVLVIYGKNNRPSGIPDRFSGSSSGNTASLTITGAQAEDEADYYCMSRDSPG
NQWVFGGGTKVTVLG
(SEQ ID NO:375)

*Fig. 6D (cont.)*

16F Heavy Chain Sequence:

Leader sequence
MGFGLSWLFLVAILKGVQCEVQLLQSGGGLVQPGGSLRLSCAASGFTFSYYPMHWVRQAPGKGLE
                                        VHCDR1
                                                                     VHCDR3
WVSSISSSGGATRYADSVKGRFTISRDNSKNTLYLQMNSLRAEDTAVYYCAKDFYDILIGNAEDIWGQG
     VHCDR2
TTVTVSS**ASTKGPSVFPLAPSSKSTSGGTAALGCLVKDYFPEPVTVSWNSGALTSGVHTFPAVLQSSGL
       ↑ IgG1 CH1                                                                     IgG1 CH2
YSLSSVVTVPSSSLGTQTYICNVNHKPSNTKVDKKVEPKSCDKTHTCPPCPAPELLG**GPSVFLFPPKPK
                                             ↑ IgG1 hinge
DTLMISRTPEVTCVVVDVSHEDPEVKFNWYVDGVEVHNAKTKPREEQYNSTYRVVSVLTVLHQDWLNG
KEYKCKVSNKALPAPIEKTISKAK**GQPREPQVYTLPPSREEMTKNQVSLTCLVKGFYPSDIAVEWESNGQ
              ↑ IgG1 CH3                                                                                  connecting
PENNYKTTPPVLDSDGSFFLYSKLTVDKSRWQQGNVFSCSVMHEALHNHYTQKSLSLSPG**GGGGSGG
linker ↑ scFv VH                                                                     VHCDR2
GGSGGGGSQVQLVQSGGGLVQPGGSLRLSCAASGFTFDDYAMHWVRQAPGKGLEWVAGISWNSGSI
                                                      VHCDR1
                                                                         VHCDR3
GYADSVKGRFTISRDNAKNSLYLQMNSLRPEDTAVYYCARDLGYNQWVEGFDYWGQGTLVTVSS**ASTG
                                                                   VLCDR1
                  scFv linker        ↑ scFv VL
GGGSGGGGSGGGGSGGGGSSYELTQDPAVSVALGQTVRITCQGDSLRSYYASWYQQKPGQAPVLVIY
VLCDR2                                                                 VLCDR3
GKNNRPSGIPDRFSGSTSGNSASLTITGAQAEDEADYYCNSRDSSGNHWVFGGGTKVTVLG
(SEQ ID NO: 300)

*Fig. 7A*

16F Light Chain Sequence:

Leader sequence
MGTPAQLLFLLLLWLPDTTGDIQMTQSPSSLSASTGDRVTITCRASQGISSY
                                              VL CDR1
LAWYQQKPGKAPKLLIYAASTLQSGVPSRFSGSGSGTDFTLTISSLQPEDFAT
        VLCDR2                    CL
YYCQQYFTFPLTFGGGTKVEIKRTVAAPSVFIFPPSDEQLKSGTASVVCLLNN
    VLCDR3

FYPREAKVQWKVDNALQSGNSQESVTEQDSKDSTYSLSSTLTLSKADYEKH

KVYACEVTHQGLSSPVTKSFNRGEC

*Fig. 7B*

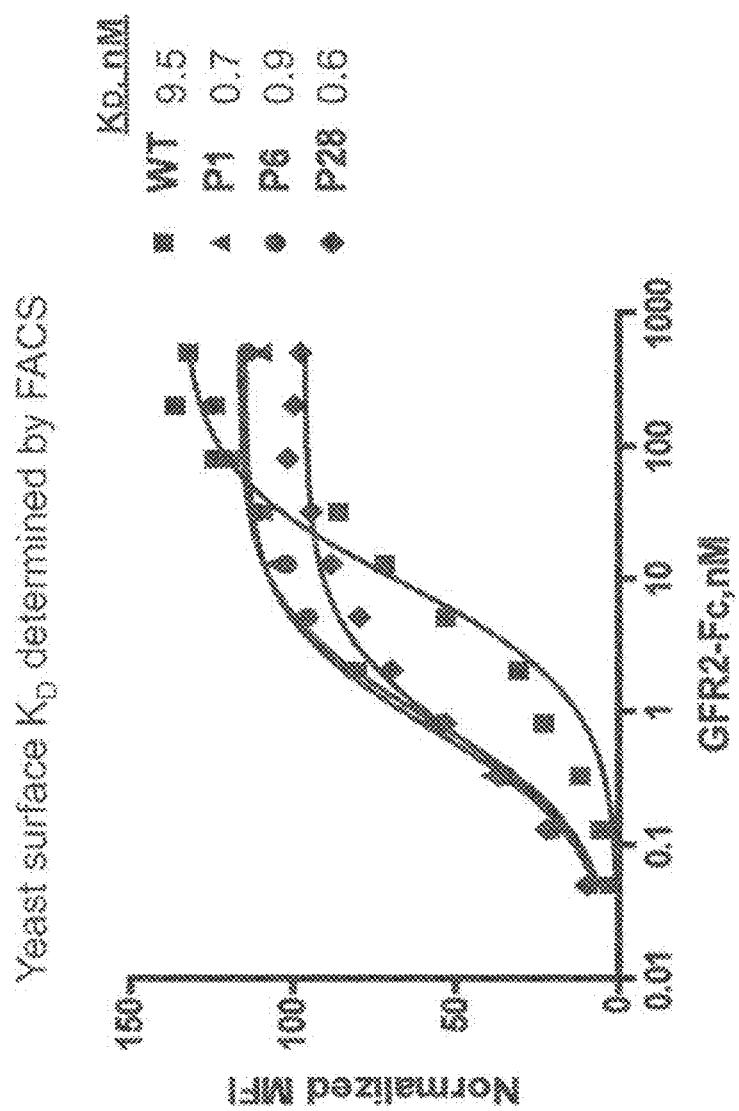

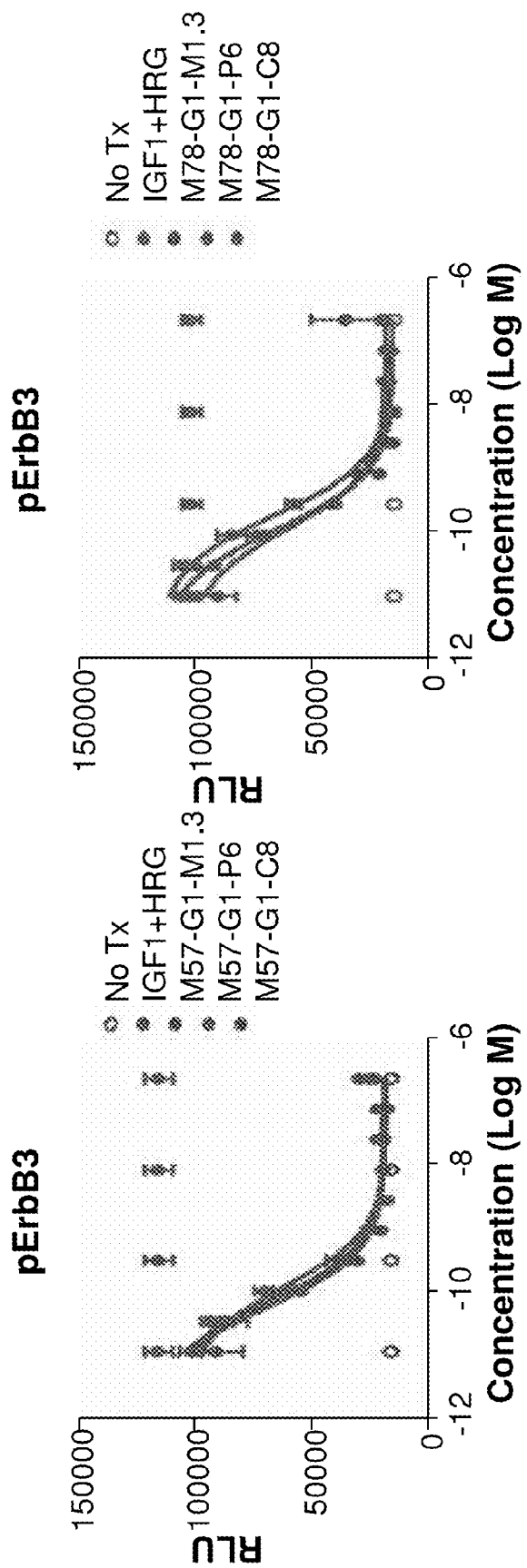

Anti-IGF1R part

CP-751,871 Fab

Fab-HC
EVQLLESGGGLVQPGGSLRLSCTASGFTFSSYAMNWVRQAPGKGLEWVSA
ISGSGGTTFYADSVKGRFTISRDNSRTTLYLQMNSLRAEDTAVYYCAKDL
GWSDSYYYYYGMDVWGQGTTVTVSSASTKGPSVFPLAPSSKSTSGGTAALGCLVKDYF
PEPVTVSWNSGALTSGVHTFPAVLQSSGLYSLSSVVTVPSSSLGTQTYICNVNHKPSNTK
VDKKV    (SEQ ID NO: 321)

LC
DIQMTQFPSSLSASVGDRVTITCRASQGIRNDLGWYQQKPGKAPKRLIYAASRLHRGVPS
RFSGSGSGTEFTLTISSLQPEDFATYYCLQHNSYPCSFGQGTKLEIKRTVAAPSVFIFPPSDE
QLKSGTASVVCLLNNFYPREAKVQWKVDNALQSGNSQESVTEQDSKDSTYSLSSTLTLS
KADYEKHKVYACEVTHQGLSSPVTKSFNRGEC    (SEQ ID NO: 322)

CP-751,871 scFv

EVQLLESGGGLVQPGGSLRLSCTASGFTFSSYAMNWVRQAPGKGLEWVSA
ISGSGGTTFYADSVKGRFTISRDNSRTTLYLQMNSLRAEDTAVYYCAKDL
GWSDSYYYYYGMDVWGQGTTVTVSSASTGGGGSGGGGSGGGGSDIQMTQFPS
SLSASVGDRVTITCRASQGIRNDLGWYQQKPGKAPKRLIYAASRLHRGVPSRFSGSGSGT
EFTLTISSLQPEDFATYYCLQHNSYPCSFGQGTKLEIKRT    (SEQ ID NO: 323)

IMC-A12 Fab

Fab-HC
EVQLVQSGAEVKKPGSSVKVSCKASGGTFSSYAISWVRQAPGQGLEWMGG
IIPIFGTANYAQKFQGRVTITADKSTSTAYMELSSLRSEDTAVYYCARAP
LRFLEWSTQDHYYYYYMDVWGKGTTVTVSSASTKGPSVFPLAPSSKSTSGGTAALGCL
VKDYFPEPVTVSWNSGALTSGVHTFPAVLQSSGLYSLSSVVTVPSSSLGTQTYICNVNHK
PSNTKVDKKV    (SEQ ID NO: 324)

LC
SSELTQDPAVSVALGQTVRITCQGDSLRSYYATWYQQKPGQAPILVIYGENKRPSGIPDR
FSGSSSGNTASLTITGAQAEDEADYYCKSRDGSGQHLVFGGGTKLTVLGQPKAAPSVTLF
PPSSEELQANKATLVCLISDFYPGAVTVAWKADSSPVKAGVETTTPSKQSNNKYAASSY
LSLTPEQWKSHRSYSCQVTHEGSTVEKTVAPAECS(SEQ ID NO: 325)

IMC-A12 scFV

EVQLVQSGAEVKKPGSSVKVSCKASGGTFSSYAISWVRQAPGQGLEWMGG
IIPIFGTANYAQKFQGRVTITADKSTSTAYMELSSLRSEDTAVYYCARAP
LRFLEWSTQDHYYYYYMDVWGKGTTVTVSSASTGGGGSGGGGSGGGGSSSEL
TQDPAVSVALGQTVRITCQGDSLRSYYATWYQQKPGQAPILVIYGENKRPSGIPDRFSGS
SSGNTASLTITGAQAEDEADYYCKSRDGSGQHLVFGGGTKLTVLG    (SEQ ID NO: 326)

AMG-479 Fab

*Fig. 37A*

Fab-HC
QVQLQESGPGLVKPSGTLSLTCAVSGGSISSSNWWSWVRQPPGKGLEWIGEIYHSGSTNY
NPSLKSRVTISVDKSKNQFSLKLSSVTAADTAVYYCARWTGRTDAFDIWGQGTMVTVSS
ASTKGPSVFPLAPSSKSTSGGTAALGCLVKDYFPEPVTVSWNSGALTSGVHTFPAVLQSS
GLYSLSSVVTVPSSSLGTQTYICNVNHKPSNTKVDKKV     (SEQ ID NO: 327)

LC
DVVMTQSPLSLPVTPGEPASISCRSSQSLLHSNGYNYLDWYLQKPGQSPQLLIYLGSNRA
SGVPDRFSGSGSGTDFTLKISRVEAEDVGVYYCMQGTHWPLTFGQGTKVEIKRTVAAPS
VFIFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC        (SEQ ID NO: 328)

AMG-479 scFv

QVQLQESGPGLVKPSGTLSLTCAVSGGSISSSNWWSWVRQPPGKGLEWIGEIYHSGSTNY
NPSLKSRVTISVDKSKNQFSLKLSSVTAADTAVYYCARWTGRTDAFDIWGQGTMVTVSS
ASTGGGGSGGGGSGGGGSGGGGSDVVMTQSPLSLPVTPGEPASISCRSSQSLLHSNGYN
YLDWYLQKPGQSPQLLIYLGSNRASGVPDRFSGSGSGTDFTLKISRVEAEDVGVYYCMQ
GTHWPLTFGQGTKVEIKRT   (SEQ ID NO: 329)

BIIB-G11 Fab

Fab-HC

EVQLLESGGGLVQPGGSLRLSCAASGFTFSNYPMYWVRQAPGKGLEWVSRISSSGGRTV
YADSVKGRFTISRDNSKNTLYLQMNSLRAEDTAVYYCARDRWSRSAAEYGLGGYWGQ
GTLVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKV           (SEQ ID NO:
330)

LC

DIQMTQSPDSLAVSLGERATINCKSSQSVLYSSNNKNYLAWYQQKPGQPPKLLIYLASTR
ESGVPDRFSGSGSGTDFTLTISSLQAEDVAVYYCQQYYSTWTFGQGTKVEIKRTVAAPSV
FIFPPSDEQLKSGTASVVCLLNNFYPREAKVQWKVDNALQSGNSQESVTEQDSKDSTYSL
SSTLTLSKADYEKHKVYACEVTHQGLSSPVTKSFNRGEC   (SEQ ID NO: 331)

BIIB-G11 scFv

EVQLLESGGGLVQPGGSLRLSCAASGFTFSNYPMYWVRQAPGKGLEWVSRISSSGGRTV
YADSVKGRFTISRDNSKNTLYLQMNSLRAEDTAVYYCARDRWSRSAAEYGLGGYWGQ
GTLVTVSSASTGGGGSGGGGSGGGGSGGGGSDIQMTQSPDSLAVSLGERATINCKSSQS
VLYSSNNKNYLAWYQQKPGQPPKLLIYLASTRESGVPDRFSGSGSGTDFTLTISSLQAED
VAVYYCQQYYSTWTFGQGTKVEIKRT      (SEQ ID NO: 332)

*Fig. 37B*

BIIB-C06 Fab

Fab-HC

EVQLLESGGGLVQPGGSLRLSCAASGFTFSIYRMQWVRQAPGKGLEWVSGISPSGGTTW
YADSVKGRFTISRDNSKNTLYLQMNSLRAEDTAVYYCARWSGGSGYAFDIWGQGTMV
TVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKV     (SEQ ID NO: 333)

LC

DIQMTQSPLSLSASVGDRVTITCQASRDIRNYLNWYQQKPGKAPKLLIYDASSLQTGVPS
RFGGSGSGTDFSFTIGSLQPEDIATYYCQQFDSLPHTFGQGTKLEIKRTVAAPSVFIFPPSD
EQLKSGTASVVCLLNNFYPREAKVQWKVDNALQSGNSQESVTEQDSKDSTYSLSSTLTL
SKADYEKHKVYACEVTHQGLSSPVTKSFNRGEC     (SEQ ID NO: 334)

BIIB-C06 scFv

EVQLLESGGGLVQPGGSLRLSCAASGFTFSIYRMQWVRQAPGKGLEWVSGISPSGGTTW
YADSVKGRFTISRDNSKNTLYLQMNSLRAEDTAVYYCARWSGGSGYAFDIWGQGTMV
TVSSASTGGGGSGGGGSGGGGSGGGGSDIQMTQSPLSLSASVGDRVTITCQASRDIRNYL
NWYQQKPGKAPKLLIYDASSLQTGVPSRFGGSGSGTDFSFTIGSLQPEDIATYYCQQFDSL
PHTFGQGTKLEIKRT (SEQ ID NO: 335)

*Fig. 37C*

Anti-ErbB3 part

AMG-888 (U3) Fab

Fab-HC

QVQLQQWGAGLLKPSETLSLTCAVYGGSFSGYYWSWIRQPPGKGLEWIGEINHS
GSTNYNPSLKSRVTISVETSKNQFSLKLSSVTAADTAVYYCARDKWTWYFDLW
GRGTLVTVSSASTKGPSVFPLAPSSKSTSGGTAALGCLVKDYFPEPVTVSWNSGA
LTSGVHTFPAVLQSSGLYSLSSVVTVPSSSLGTQTYICNVNHKPSNTKVDKKV
    (SEQ ID NO: 336)

LC

DIEMTQSPDSLAVSLGERATINCRSSQSVLYSSSNRNYLAWYQQNPGQPPKLLIY
WASTRESGVPDRFSGSGSGTDFTLTISSLQAEDVAVYYCQQYYSTPRTFGQGTKV
EIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC
    (SEQ ID NO: 337)

AMG-888 (U3 Pharma) scFv

QVQLQQWGAGLLKPSETLSLTCAVYGGSFSGYYWSWIRQPPGKGLEWIGEINHS
GSTNYNPSLKSRVTISVETSKNQFSLKLSSVTAADTAVYYCARDKWTWYFDLW
GRGTLVTVSSASTGGGGSGGGGSGGGGSGGGGSDIEMTQSPDSLAVSLGERATI
NCRSSQSVLYSSSNRNYLAWYQQNPGQPPKLLIYWASTRESGVPDRFSGSGSGT
DFTLTISSLQAEDVAVYYCQQYYSTPRTFGQGTKVEIKRT    (SEQ ID NO: 338)

H3 (US Pat No 7,332,580) Fab

Fab-HC
QVQLQESGGGLVKPGGSLRLSCAASGFTFSSYWMSWVRQAPGKGLEWVANINR
DGSASYYVDSVKGRFTISRDDAKNSLYLQMNSLRAEDTAVYYCARDRGVGYFD
LWGRGTLVTVSSASTKGPSVFPLAPSSKSTSGGTAALGCLVKDYFPEPVTVSWNS
GALTSGVHTFPAVLQSSGLYSLSSVVTVPSSSLGTQTYICNVNHKPSNTKVDKKV
    (SEQ ID NO: 339)

LC
QSALTQPASVSGSPGQSITISCTGTSSDVGGYNFVSWYQQHPGKAPKLMIYDVSD
RPSGVSDRFSGSKSGNTASLIISGLQADDEADYYCSSYGSSSTHVIFGGGTKVTVL
GQPKAAPSVTLFPPSSEELQANKATLVCLISDFYPGAVTVAWKADSSPVKAGVET
TTPSKQSNNKYAASSYLSLTPEQWKSHRSYSCQVTHEGSTVEKTVAPAECS
    (SEQ ID NO: 340)

*Fig. 38A*

H3 (US Pat No 7,332,580) scFv

QVQLQESGGGLVKPGGSLRLSCAASGFTFSSYWMSWVRQAPGKGLEWVANINR
DGSASYYVDSVKGRFTISRDDAKNSLYLQMNSLRAEDTAVYYCARDRGVGYFD
LWGRGTLVTVSSASTGGGGSGGGGSGGGGSGGGGSQSALTQPASVSGSPGQSITI
SCTGTSSDVGGYNFVSWYQQHPGKAPKLMIYDVSDRPSGVSDRFSGSKSGNTAS
LIISGLQADDEADYYCSSYGSSSTHVIFGGGTKVTVLG        (SEQ ID NO: 341)

MM AB#3 Fab

Fab-HC

EVQLLESGGGLVQPGGSLRLSCAASGFTFSAYNMRWVRQAPGKGLEWVSVIYPS
GGATRYADSVKGRFTISRDNSKNTLYLQMNSLRAEDTAVYYCARGYYYYGMD
VWGQGTLVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKK
V        (SEQ ID NO: 342)

LC

QSVLTQPPSASGTPGQRVTISCSGSDSNIGRNYIYWYQQFPGTAPKLLIYRNNQRP
SGVPDRISGSKSGTSASLAISGLRSEDEAEYHCGTWDDSLSGPVFGGGTKLTVLG
QPKAAPSVTLFPPSSEELQANKATLVCLISDFYPGAVTVAWKADSSPVKAGVETT
TPSKQSNNKYAASSYLSLTPEQWKSHRSYSCQVTHEGSTVEKTVAPAECS
(SEQ ID NO: 343)

MM AB#3 scFv

EVQLLESGGGLVQPGGSLRLSCAASGFTFSAYNMRWVRQAPGKGLEWVSVIYPS
GGATRYADSVKGRFTISRDNSKNTLYLQMNSLRAEDTAVYYCARGYYYYGMD
VWGQGTLVTVSSASTGGGGSGGGGSGGGGSGGGGSQSVLTQPPSASGTPGQRV
TISCSGSDSNIGRNYIYWYQQFPGTAPKLLIYRNNQRPSGVPDRISGSKSGTSASL
AISGLRSEDEAEYHCGTWDDSLSGPVFGGGTKLTVLG        (SEQ ID NO: 344)

MM AB#14 Fab

Fab-HC
EVQLLESGGGLVQPGGSLRLSCAASGFTFSAYGMGWVRQAPGKGLEWVSYISPS
GGHTKYADSVKGRFTISRDNSKNTLYLQMNSLRAEDTAVYYCAKVLETGLLVD
AFDIWGQGTMVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVD
KKV  (SEQ ID NO: 345)

QYELTQPPSVSVYPGQTASITCSGDQLGSKFVSWYQQRPGQSPVLVMYKDKRRP
SEIPERFSGSNSGNTATLTISGTQAIDEADYYCQAWDSSTYVFGTGTKVTVLGQP
KAAPSVTLFPPSSEELQANKATLVCLISDFYPGAVTVAWKADSSPVKAGVETTTP
SKQSNNKYAASSYLSLTPEQWKSHRSYSCQVTHEGSTVEKTVAPAECS (SEQ
ID NO: 346)

MM AB#14 scFv

EVQLLESGGGLVQPGGSLRLSCAASGFTFSAYGMGWVRQAPGKGLEWVSYISPS
GGHTKYADSVKGRFTISRDNSKNTLYLQMNSLRAEDTAVYYCAKVLETGLLVD
AFDIWGQGTMVTVSSASTGGGGSGGGGSGGGGSQYELTQPPSVSVYPG
QTASITCSGDQLGSKFVSWYQQRPGQSPVLVMYKDKRRPSEIPERFSGSNSGNTA
TLTISGTQAIDEADYYCQAWDSSTYVFGTGTKVTVLG (SEQ ID NO: 347)

MM AB#17 Fab

Fab-HC

EVQLLESGGGLVQPGGSLRLSCAASGFTFSWYGMGWVRQAPGKGLEWVSYISP
SGGITVYADSVKGRFTISRDNSKNTLYLQMNSLRAEDTAVYYCARLNYYYGLD
VWGQGTTVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKK
V (SEQ ID NO: 348)

LC

DIQMTQSPSSLSASVGDRITITCQASQDIGDSLNWYQQKPGKAPRLLIYDASNLET
GVPPRFSGSGSGTDFTFTFRSLQPEDIATYFCQQSANAPFTFGPGTKVDIKRTVAA
PSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC (SEQ
ID NO: 349)

MM AB#17 scFv

EVQLLESGGGLVQPGGSLRLSCAASGFTFSWYGMGWVRQAPGKGLEWVSYISP
SGGITVYADSVKGRFTISRDNSKNTLYLQMNSLRAEDTAVYYCARLNYYYGLD
VWGQGTTVTVSSASTGGGGSGGGGSGGGGSDIQMTQSPSSLSASVGDRI
TITCQASQDIGDSLNWYQQKPGKAPRLLIYDASNLETGVPPRFSGSGSGTDFTFTF
RSLQPEDIATYFCQQSANAPFTFGPGTKVDIKRT (SEQ ID NO: 350)

*Fig. 38C*

MM AB#19 Fab

Fab-HC

EVQLLESGGGLVQPGGSLRLSCAASGFTFSRYGMWWVRQAPGKGLEWVSYIGS
SGGPTYYVDSVKGRFTISRDNSKNTLYLQMNSLRAEDTAVYYCAGGRGTPYYF
DSWGQGTLVTVSSASTKGPSVFPLAPSSKSTSGGTAALGCLVKDYFPEPVTVSW
NSGALTSGVHTFPAVLQSSGLYSLSSVVTVPSSSLGTQTYICNVNHKPSNTKVDK
KV     (SEQ ID NO: 351)

LC

QYELTQPASVSGSPGQSITISCTGTSSDIGRWNIVSWYQQHPGKAPKLMIYDVSN
RPSGVSNRFSGSKSGNTASLTISGLQAEDEADYYCSSYTSSSTWVFGGGTKLTVL
GQPKAAPSVTLFPPSSEELQANKATLVCLISDFYPGAVTVAWKADSSPVKAGVET
TTPSKQSNNKYAASSYLSLTPEQWKSHRSYSCQVTHEGSTVEKTVAPAECS
         (SEQ ID NO: 352)

MM AB#19 scFv

EVQLLESGGGLVQPGGSLRLSCAASGFTFSRYGMWWVRQAPGKGLEWVSYIGS
SGGPTYYVDSVKGRFTISRDNSKNTLYLQMNSLRAEDTAVYYCAGGRGTPYYF
DSWGQGTLVTVSSASTGGGGSGGGGSGGGGSGGGGSQYELTQPASVSGSPGQSI
TISCTGTSSDIGRWNIVSWYQQHPGKAPKLMIYDVSNRPSGVSNRFSGSKSGNTA
SLTISGLQAEDEADYYCSSYTSSSTWVFGGGTKLTVLG         (SEQ ID NO: 353)

*Fig. 38D*

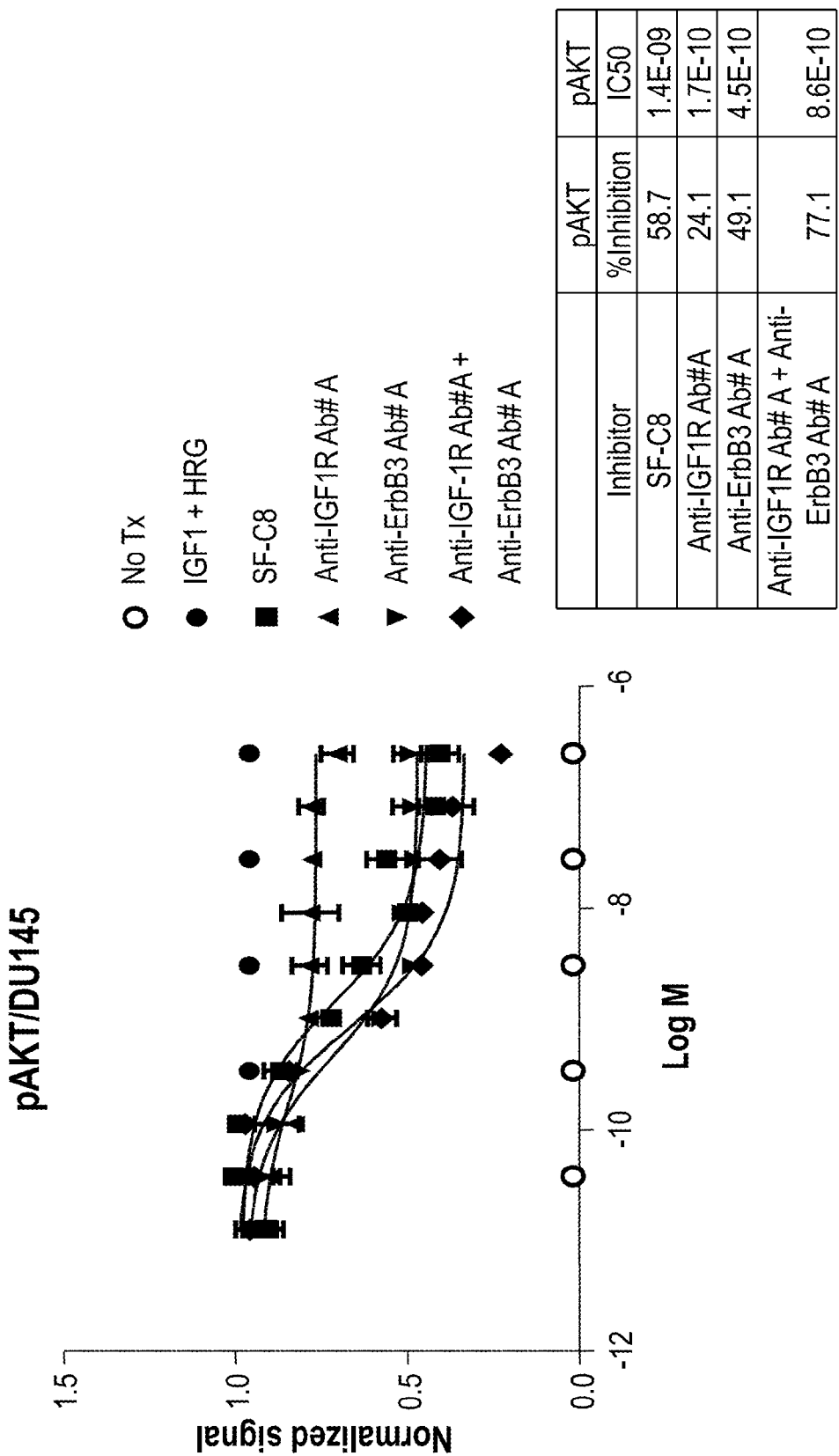

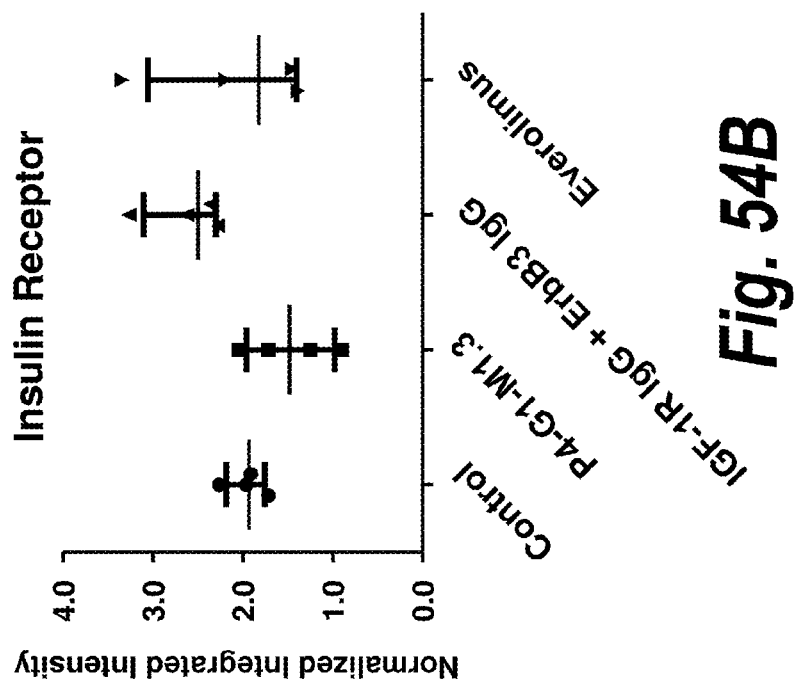
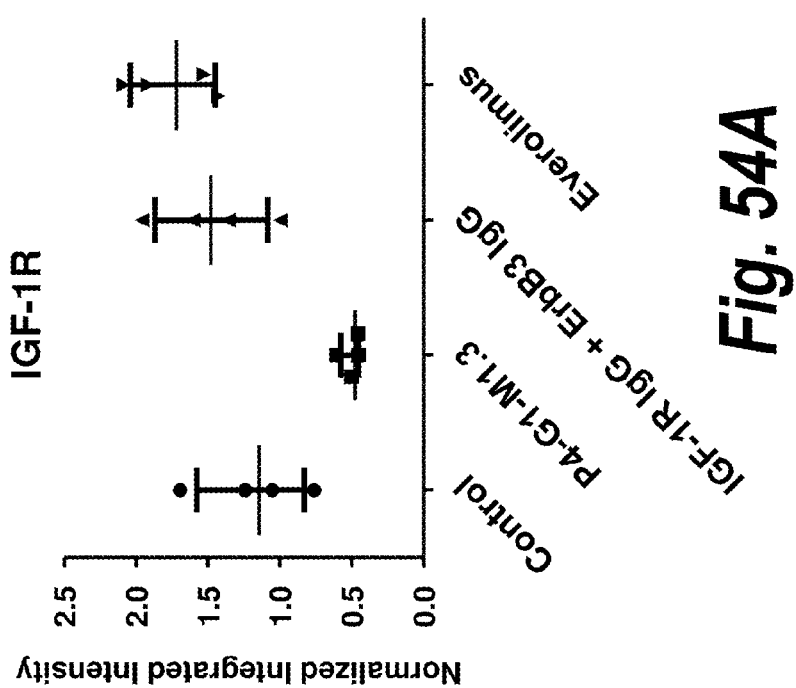
Fig. 54B
Fig. 54A

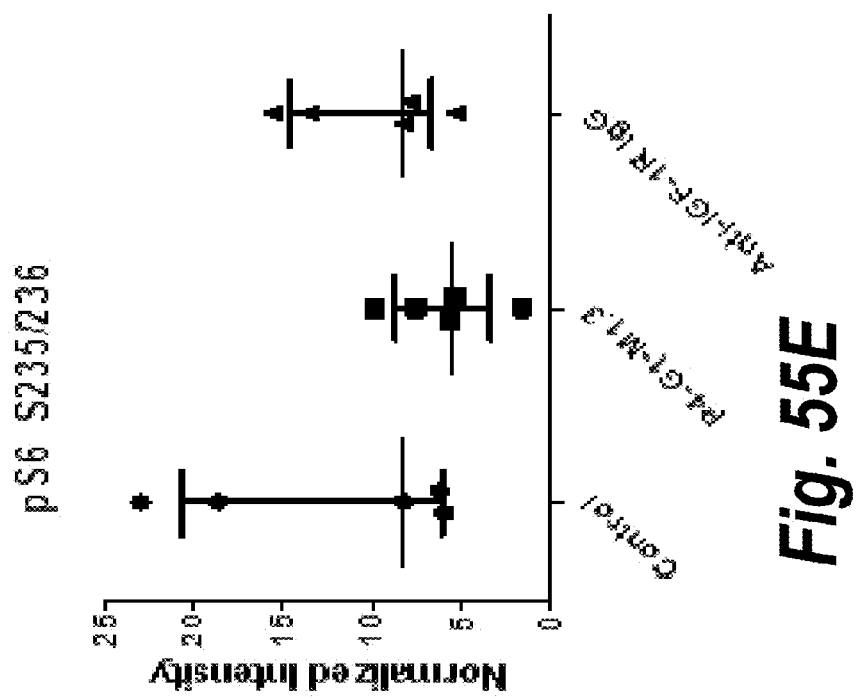

BISPECIFIC ANTI-IGF-1R AND ANTI-ERBB3 ANTIBODIES

RELATED APPLICATIONS

This application claims priority to U.S. Provisional Application No. 61/477,089, filed Apr. 19, 2011; U.S. Provisional Application No. 61/539,297, filed Sep. 26, 2011; U.S. Provisional Application No. 61/558,192, filed Nov. 10, 2011 and U.S. Provisional Application No. 61/619,244, filed Apr. 2, 2012. Where permitted, the foregoing applications are incorporated by reference, each in its entirety, for any and all purposes.

SEQUENCE LISTING

The instant application contains a Sequence Listing which has been submitted in ASCII format via EFS-Web and is hereby incorporated by reference in its entirety. Said ASCII copy, created on Apr. 5, 2012, is named 1141PC01.txt and is 950,611 bytes in size.

BACKGROUND

Tumor cells express receptors for growth factors and cytokines that stimulate proliferation of the cells. Antibodies to such receptors can be effective in blocking the stimulation of cell proliferation mediated by growth factors and cytokines and can thereby inhibit tumor cell proliferation and tumor growth. Commercially available therapeutic antibodies that target receptors on cancer cells include, for example, trastuzumab which targets the HER2 receptor (also known as ErbB2) for the treatment of breast cancer, and cetuximab which targets the epidermal growth factor receptor (EGFR, also known as HER1 or ErbB1) for the treatment of colorectal cancer and head and neck cancer.

Monoclonal antibodies have significantly advanced our ability to treat cancers, yet clinical studies have shown that many patients do not adequately respond to monospecific therapy. This is in part due to the multigenic nature of cancers, where cancer cells rely on multiple and often redundant pathways for proliferation. Bi- or multi-specific antibodies capable of blocking multiple growth and survival pathways at once have a potential to better meet the challenge of blocking cancer growth, and indeed many of them are advancing in clinical development. However, bispecific antibodies present significant design challenges, due to the greatly increased number of variables that need to be considered in their design and optimization, as well as to their structural differences from naturally occurring antibodies.

Monoclonal antibodies such as trastuzumab, cetuximab, bevacizumab and panitumumab have significantly improved patient outcomes in the clinic, and over two hundred therapeutic monoclonal antibodies are currently being tested in clinical development. However, it has become apparent that tumors driven by single oncogenes are not the norm, and treatment often results in activation of resistance mechanisms, which in turn also require targeted intervention. For example, in multiple pre-clinical models of trastuzumab resistance, inhibition of IGF-1R restores sensitivity to trastuzumab. Combination of targeted agents has been attempted in the clinic, but so far they have had limited clinical success and in combination can be prohibitively expensive. The need to inhibit multiple targets either due to resistance or to tumors being driven by multiple growth factor pathways has led to increased interest in bispecific antibodies. Currently developed bispecific antibodies were typically designed in empirical fashion. Further, the pharmaceutical properties of these bispecific antibodies were almost invariably inferior to those of monoclonal antibodies. These factors present a major challenge to the development of bispecific anti-cancer therapies. Significant added benefit from targeting multiple cancer survival pathways can be derived from increased work up front to identify and engineer a bispecific antibody with optimal characteristics. This requires an iterative approach consisting of computational simulation to identify optimal targeting strategies and design specifications, engineering of inhibitors that possess these characteristics, and experimental validation of the therapeutic hypothesis. We separate this engineering framework into two categories: selection of appropriate molecular format with robust pharmaceutical properties and computational simulation to identify the best targets and optimal therapeutic design characteristics, e.g., in an IgG-like bispecific antibody (FIG. 8).

One of the main advantages of antibodies is their ability to bind tightly to virtually any extracellular target. This property is driven by two features of antibody variable regions (VRs): the large flat surface of six complementarity determining regions (CDRs) and the fact that antibodies have two binding arms that can target two molecules simultaneously. In bispecific antibodies, dual target binding results in tighter affinity because once one arm of the antibody is bound to an extracellular target, the second arm is restricted to a narrow region above the plasma membrane (about 100 angstroms), and is, therefore, concentrated near the cell surface. This results in a much faster secondary binding event that is not limited by diffusion. The acceleration of a secondary binding event is called. Both affinity and avidity are rationally engineerable properties, as the former can be improved via in silico affinity maturation and the latter can be enhanced by engineering additional targeting arms to the same or different antigen present on the cell surface. In addition to their binding capabilities, antibodies may possess multiple effector functions mediated by their Fc domain: antibody-dependent cellular cytotoxicity (ADCC) and antibody-dependent cellular phagocytosis (ADCP) that in humans are determined by interactions with activating FcγRI, FcγRIIa/c, FcγRIIIa and inhibitory FcγRIIb receptors; complement-dependent cytotoxicity (CDC) that is triggered by antibody binding to the components of the complement system; and long half-life that is mediated via active recycling by the neonatal Fc receptor (FcRn). All of these functions can be tuned to optimize the effectiveness of an anti-cancer therapy and are may be retained to advantage in a bispecific protein.

The variable fragment (Fv), composed of the variable heavy (VH) and variable light (VL) domains of an IgG antibody, is a minimal antibody fragment that displays full antigen binding. These variable domains can be successfully fused into a single chain construct (scFv), although affinity is often reduced to some extent compared to a whole native antibody. A majority of current bispecific formats feature one or several scFv modules attached to the N- or C-terminus of an IgG heavy chain or IgG light chain via a low complexity linker. Another bispecific antibody format is dual variable domain immunoglobulin (DVD-Ig). DVD-Ig consists of a first IgG heavy chain with a second VH domain linked to its N-terminus by a short linker, and a first IgG light chain with a second VL domain similarly linked to its N-terminus. The second VH/VL domains form a pair with specificity for one antigen while the first VH/VL form a separate binding site with specificity for a different antigen.

Bivalent formats of IgG-like antibodies have one potential limitation; they can cross-link cell surface antigens, some of which are activated by dimerization, triggering undesirable signaling events in an uncontrolled manner. To address this challenge, tunable monovalent bispecific antibody formats have been developed. MetMab, a one armed anti-c-Met therapeutic antibody created by incorporating asymmetric "knobs and holes" into the Fc fragment, has been shown to be effective in models of pancreatic cancer and is being investigated in multiple clinical trials. This "knobs and holes" format has been recently extended to incorporate an antibody fragment targeting EGFR, giving rise to a functionally monovalent bispecific protein targeting EGFR/ErbB1 and c-Met/HGFR. Gunasekaran et al. have described an alternative implementation of the "knobs and holes" concept by engineering complementary charged surfaces into the Fc fragment. Davis et al. have described a "SEED" approach that used modified asymmetric Fc containing fragments from human IgG and IgA to form heteromeric monovalent antibodies. Finally, Bostrom et al. has described a novel engineering approach to construct bifunctional Fab fragment that can bind either HER2 or VEGF with high affinity. When combined in a canonical antibody molecule, these Fab fragments will engage HER2 or VEGF with different valences that will depend on the cellular environment and growth factor concentration.

Another important component of a bispecific antibody design is the optimization of pharmaceutical properties. To be clinically useful, a therapeutic protein must be stable, remain soluble over an extended period of time and possess a robust manufacturability profile. Bispecific antibodies are typically less stable than monoclonal antibodies, and initially may not possess adequate pharmaceutical properties for development. They can be stabilized through molecular engineering, through downstream formulation activities, or, as most commonly practiced, through the combination of both approaches.

The importance of minimizing chemical manufacturing and control liabilities in small molecule drug candidates has been long recognized and the rules to predict drug-likeness have been proposed. Many groups have used conceptually similar approaches to assess the fitness of IgG based proteins by evaluating unfavorable sequence features such as: non-canonical disulfides or unpaired cysteines, extra glycosylation sites, tyrosine sulfation motifs, solvent accessible methionines, asparagine deamidation motifs, and acid cleavage sites. Extra glycosylation sites and asparagine deamidation sites are quite common features of natural antibodies sequences. In fact over 20% of variable domains of heavy chains are reported to be glycosylated and over 5% of germline genes contain asparagine-glycine deamidation motifs. Deamidation rates in antibodies can be reliably estimated using the method proposed by Robinson that suggests that structurally constrained loops do not form a succinimide intermediate efficiently and therefore are stable.

While the canonical N-linked glycosylation motif (NXS and NXT, where X is any aa but proline) can be easily detected in antibody sequence, O-linked sites, which are liabilities in that they can also negatively impact pharmaceutical properties, are more difficult to recognize. Recently several O-linked modifications of variable domains of antibody light chains have been reported, mostly in the proximity of GS rich sequence motifs. Many approaches to improve the affinity and stability of a candidate protein at the discovery stage exist including structure-guided design, focused library screening and yeast display; therefore, we find it beneficial to remove such potential liabilities at risk in the early proof-of-concept proteins.

Other liabilities, such as aggregation and immunogenicity are more challenging from an engineering perspective. Not only are both multifaceted properties, but it is also very difficult to adequately evaluate them in small scale biochemical and biophysical testing and, therefore, they tend to first be detected late in development. Arguably the best approach to reduce antibody immunogenicity is through humanization. This approach has been extensively validated by a number of humanized antibodies that have been well-tolerated in the clinic. A recently proposed "superhumanization" approach introduces human germline sequences into the CDRs to yield 'fully human' antibodies. This approach requires each amino acid ("aa") in the CDRs to be mutated in order to determine its contribution to antigen binding; the resulting antibody may be less immunogenic. Aside from sequence-based features, immunogenicity of antibodies and antibody-like proteins can be dependent on their aggregation stability. Interestingly, the "humanness" and the stability in an antibody module, such as scFv, can be co-engineered via a knowledge-based approach.

Engineering of protein antibody solubility is another daunting task, as the property is also a composite of several physico-chemical parameters. Nevertheless, a number of methods to combat insolubility have been proposed. Pepinsky et al. have used glycoengineering, isotype switching, and structure-guided mutagenesis, to increase the solubility of a monoclonal antibody. Chennamsetty et al. have described an unbiased approach to improving stability with respect to aggregation that relies on molecular dynamics simulations to calculate a parameter called surface aggregation propensity and applied this technique to introduce stabilizing amino acids ("aas") in the aggregation-prone regions of antibodies. Interestingly, in their analysis of antibodies, aggregation prone regions often co-locate with functionally important regions that confer Fc receptor or antigen binding and, therefore, cannot be easily removed.

Such a coupling between molecular function and pharmaceutical properties in antibodies is common. It can significantly complicate optimization of the bispecific antibodies, as even larger parts of their sequences are located in the functionally important regions. Therefore, to enable successful engineering it is important to identify critical molecular functions and optimal design characteristics.

Computational Simulation to Identify Best Targets and Optimal Therapeutic Design Characteristics Computational simulation is a valuable tool for guiding drug development decisions, both in the laboratory and in the clinic. Population pharmacokinetic modeling is a mature example of the use of models to optimize dose scheduling and clinical trial designs. For therapies with known targets it is possible to utilize computational simulation much earlier in the design process. Advances in multiplex, high-throughput quantitative protein measurement technologies have enabled observation of the complex dynamics that occur in cellular signaling networks. These data permit the creation of network models which capture the mechanistic behaviors of biological systems that are relevant to diseases such as cancer. By simulating potential therapeutics through network modeling it is possible to design more effective therapeutics at an accelerated pace and more accurately predict design parameters.

Traditionally, selection of a pharmaceutical agent for a targeted therapy begins with a known target which is selected from a multitude of molecular, biological and physiological data. However, even in well-studied and heavily targeted biological systems there are opportunities for new discoveries, which can be aided by simulation of pathway or network models.

Accordingly, additional therapeutic approaches for cancer treatment, and in particular polyspecific antibody-based proteins that are engineered to have superior biophysical and

SUMMARY

Provided herein are polyvalent bispecific antibodies (PBA), which antibodies are proteins comprising two pairs of polypeptide chains, each pair of said two pairs comprising a heavy chain joined to a light chain by at least one heavy-light chain bond; wherein (a) each pair comprises at least one anti-IGF-1R binding site and at least one anti-ErB3 binding site; and (b) each pair comprises a first binding site that comprises an N-terminal portion of the heavy chain of the PBA and an N-terminal portion of the light chain of the PBA, and a second binding site that is a C-terminal scFv that is entirely comprised by the heavy chain of the PBA, said C-terminal scFv containing a heavy chain VR joined to a light chain VR by an scFv linker; and the anti-IGF-1R binding site is linked to the anti-ErbB3 binding site through a heavy chain immunoglobulin (HC Ig) constant region (CR) comprised by the heavy chain of the PBA, and the two pairs are conjoined by at least one bond between the HC Ig CRs of each pair. In preferred embodiments, the anti-IGF-1R binding site comprises a heavy chain variable (VH) domain comprising a set of three VH Complementarity Determining Regions (CDRs) comprising either (a) VHCDR1 (aa numbers 26-35), VHCDR2 (aa numbers 51-66), and VHCDR3 (aa numbers 99-111), of a heavy chain having an aa sequence comprising the aa sequence of (set forth in) a SEQ ID NO selected from the group consisting of SEQ ID NO:1, SEQ ID NOs:8-31 and SEQ ID NOs:384-385; or (b) a set of three VH Complementarity Determining Regions (CDRs) comprising VHCDR1 comprising SEQ ID NO:302, VHCDR2 comprising SEQ ID NO:303 and VHCDR3 comprising SEQ ID NO:304, and a light chain variable (VL) domain comprising a set of three VLCDRs comprising either (c) VLCDR1 (aa numbers 24-34), VLCDR2 (aa numbers 50-56) and VLCDR3 (aa numbers 89-97) of a light chain having an aa sequence comprising the aa sequence of a SEQ ID NO selected from the group consisting of SEQ ID NOs:2-3, SEQ ID NOs:32-133, and SEQ ID NOs:386-387; or (d) a set of three VLCDRs comprising VLCDR1 comprising SEQ ID NO:305, VLCDR2 comprising SEQ ID NO:306 and VLCDR3 comprising SEQ ID NO:307 or SEQ ID NO:308, and each CDR further comprising an amino terminus and a carboxy terminus, wherein the CDRs of each set of CDRs are arranged in the corresponding heavy or light chain in a linear amino to carboxy order of CDR1, CDR2 and CDR3, or wherein the sequences of VHCDR1, VHCDR2 and VHCDR3 comprise variable aas, which independently represent any aa set forth at the corresponding position in FIG. 1, and the sequences of VLCDR1, VLCDR2 and VLCDR3 comprise variable aas, which independently represent any aa set forth at the corresponding position in FIG. 2, with the proviso that the PBA (i) does not comprise both the anti-IGF-1R SF module and the anti-ErbB3 C8 module; or (ii) comprises at least one CDR or FR that differs in one or more aas from a CDR or FR, respectively, of the SF or C8 module. In certain embodiments, the anti-ErbB3 binding site comprises a VH domain comprising a set of three VH CDRs comprising either (e) VHCDR1 (aa numbers 26-35), VHCDR2 (aa numbers 51-66) and VHCDR3 (aa numbers 99-111) of a heavy chain having an aa sequence comprising the aa sequence of a SEQ ID NO selected from the group consisting of SEQ ID NOs:4-5, SEQ ID NOs: 134-165, and SEQ ID NO:388, or (f) a set of three VH CDRs comprising VHCDR1 comprising SEQ ID NO:309, VHCDR2 comprising SEQ ID NO:310 and VHCDR3 comprising SEQ ID NO:311, and a light chain variable (VL) domain comprising a set of three VLCDRs comprising either (g) VLCDR1 (aa numbers 23-33), VLCDR2 (aa numbers 49-55) and VLCDR3 (aa numbers 88-98), of a light chain having an aa sequence comprising the aa sequence of a SEQ ID NO selected from the group consisting of SEQ ID NOs:6-7 and SEQ ID NOs: 166-200; or (h) a light chain variable (VL) domain comprising a set of three VLCDRs comprising VLCDR1 comprising SEQ ID NO:312, VLCDR2 comprising SEQ ID NO:313 and VLCDR3 comprising SEQ ID NO:314 or SEQ ID NO:315, and each CDR further comprises an amino terminus and a carboxy terminus, wherein the CDRs of each set of CDRs are arranged in the antibody in a linear amino to carboxy order of CDR1, CDR2 and CDR3, or wherein the sequences of the VHCDR1, VHCDR2 and VHCDR3 comprise variable aas, which independently represent any aa set forth at the corresponding position in FIG. 3, and the sequences of the VLCDR1, VLCDR2 and VLCDR3 comprise variable aas, which independently represent any aa set forth at the corresponding position in FIG. 4, wherein the PBA (i) does not comprise both the anti-IGF-1R module comprising a light chain comprising SEQ ID NO:35 and a heavy chain comprising SEQ ID NO:11 and the b) an anti-ErbB3 C8 module comprising a light chain comprising SEQ ID NO:175 and a heavy chain comprising SEQ ID NO:145. In certain embodiments, the anti-IGF-1R VLCDR3 comprises SEQ ID NO:308 or the anti-ErbB3 VLCDR3 comprises SEQ ID NO:315. In certain embodiments, the two pairs of polypeptide chains are have essentially identical sequences. At least one of at least one bonds between the HC Ig CRs bonds is a disulfide bond and may be a disulfide bond or a van der Waals bond or at least one of said at least one heavy-light chain bonds is a disulfide bond and may be a disulfide bond or a van der Waals bond. In certain embodiments, the anti-ErbB3 binding site is the C-terminal scFv and in certain embodiments, the anti-IGF-1R binding site is the C-terminal scFv. The anti-IGF-1R binding site, the HC Ig CR and the anti-ErbB3 binding site of a PBA may comprise the heavy chain of that pair, which is comprised by a single, contiguous polypeptide chain.

A PBA may (i) inhibit growth of tumor cells in vitro at a concentration of 1 µM or less, or 100 nM or less, or 10 nM or less, or 1 nM or less, or ii) inhibits either or both of heregulin and IGF1 induced signal transduction with an IC50 of 10 nM or less or 1 nM or less or 100 pM or less, or a maximal percent inhibition of at least 70% or at least 80% or at least 90%, as indicated by inhibition of phosphorylation of either or both of pErbB3 and pIGF-1R. Growth inhibition may be measured with a CTG assay in DU145 cells in culture. Inhibition of signal transduction may be determined in BxPC-3 cells in culture following stimulation with IGF-1 at 80 ng/ml and heregulin at 20 ng/ml for 15 minutes.

In certain embodiments, each HC Ig CR of a PBA comprises a CH3 domain that mediates conjunction with the CH3 domain of the other pair. Each HC Ig CR may also comprise a CH2 domain, a hinge, and a CH1 domain. In certain embodiments, the CH1 domain of a PBA is linked at its C-terminus to the N-terminus of a hinge, which is linked at its C-terminus to the N-terminus of a CH2 domain, which is linked at its C-terminus to the N-terminus of a CH3 domain.

Each first binding site may comprise a first VH domain, and each CH1 domain of a PBA may be linked at its N-terminus to the C-terminus of the first VH domain. Each CH3 domain of a PBA may be linked at its C-terminus to the N-terminus of the scFv. Each CH3 domain of a PBA may be linked at its C terminus to the N-terminus of a connecting linker, which is linked at its C-terminus to the N-terminus of the scFv. Each light chain may comprise a first VL domain that associates with the first VH domain to form the first binding site. Each first VL domain may be linked at its C-terminus to the N-terminus of a CL domain. Each first binding site may be an anti-IGF-1R binding site and each scFv may be an anti-ErbB3 scFv. Each first binding site may be an anti-ErbB3 binding site and each scFv may be an anti-IGF-1R scFv. The HC Ig CR of a PBA may be an IgG CR, e.g., an IgG1 or IgG2 CR.

In certain embodiments, the anti-IGF-1R VHCDR1, VHCDR2, VHCDR3 of a PBA comprise the aa sequence of the corresponding CDRs of SEQ ID NO:8 and the anti-IGF-1R VLCDR1, VLCDR2 and VLCDR3 of the PBA comprise the aa sequence of the corresponding CDRs of SEQ ID NO:32. In certain embodiments, the anti-IGF-1R VHCDR1, VHCDR2, VHCDR3 of a PBA comprise the aa sequence of the corresponding CDRs of SEQ ID NO:9 and the anti-IGF-1R VLCDR1, VLCDR2 and VLCDR3 of the PBA comprise the aa sequence of the corresponding CDRs of SEQ ID NO:33. In certain embodiments, the anti-IGF-1R VHCDR1, VHCDR2, VHCDR3 of a PBA comprise the aa sequence of the corresponding CDRs of SEQ ID NO:10 and the anti-IGF-1R VLCDR1, VLCDR2 and VLCDR3 of the PBA comprise the aa sequence of the corresponding CDRs of SEQ ID NO:34. In certain embodiments, the anti-IGF-1R VHCDR1, VHCDR2, VHCDR3 of a PBA comprise the aa sequence of the corresponding CDRs of SEQ ID NO:11 and the anti-IGF-1R VLCDR1, VLCDR2 and VLCDR3 of the PBA comprise the aa sequence of the corresponding CDRs of SEQ ID NO:35. In certain embodiments, the anti-IGF-1R VHCDR1, VHCDR2, VHCDR3 of a PBA comprise the aa sequence of the corresponding CDRs of SEQ ID NO:8 and the anti-IGF-1R VLCDR1, VLCDR2 and VLCDR3 of the PBA comprise the aa sequence of the corresponding CDRs of SEQ ID NO:33. In certain embodiments, the anti-IGF-1R VHCDR1, VHCDR2, VHCDR3 of a PBA comprise the aa sequence of the corresponding CDRs of SEQ ID NO:10 and the anti-IGF-1R VLCDR1, VLCDR2 and VLCDR3 of the PBA comprise the aa sequence of the corresponding CDRs of SEQ ID NO:32.

In certain embodiments, the anti-ErbB3 VHCDR1, VHCDR2, VHCDR3 of a PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166. In certain embodiments, the anti-ErbB3 VHCDR1, VHCDR2, VHCDR3 of a PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167. In certain embodiments, the anti-ErbB3 VHCDR1, VHCDR2, VHCDR3 of a PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168. In certain embodiments, the anti-ErbB3 VHCDR1, VHCDR2, VHCDR3 of a PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169. In certain embodiments, the anti-ErbB3 VHCDR1, VHCDR2, VHCDR3 of a PBA comprise the aa sequence of the corresponding CDRs of SEQ ID NO:138 and the anti-ErbB3 VLCDR1, VLCDR2 and VLCDR3 of the PBA comprise the aa sequence of the corresponding CDRs of SEQ ID NO:170. In certain embodiments, the anti-ErbB3 VHCDR1, VHCDR2, VHCDR3 of a PBA comprise the aa sequence of the corresponding CDRs of SEQ ID NO:139 and the anti-ErbB3 VLCDR1, VLCDR2 and VLCDR3 of the PBA comprise the aa sequence of the corresponding CDRs of SEQ ID NO:171. In certain embodiments, the anti-ErbB3 VHCDR1, VHCDR2, VHCDR3 of a PBA comprise the aa sequence of the corresponding CDRs of SEQ ID NO:140 and the anti-ErbB3 VLCDR1, VLCDR2 and VLCDR3 of the PBA comprise the aa sequence of the corresponding CDRs of SEQ ID NO:172. In certain embodiments, the anti-ErbB3 VHCDR1, VHCDR2, VHCDR3 of a PBA comprise the aa sequence of the corresponding CDRs of SEQ ID NO:141 and the anti-ErbB3 VLCDR1, VLCDR2 and VLCDR3 of the PBA comprise the aa sequence of the corresponding CDRs of SEQ ID NOs: 173. In certain embodiments, the anti-ErbB3 VHCDR1, VHCDR2, VHCDR3 of a PBA comprise the aa sequence of the corresponding CDRs of SEQ ID NO:142 and the anti-ErbB3 VLCDR1, VLCDR2 and VLCDR3 of the PBA comprise the aa sequence of the corresponding CDRs of SEQ ID NO:174. In certain embodiments, the anti-ErbB3 VHCDR1, VHCDR2, VHCDR3 of a PBA comprise the aa sequence of the corresponding CDRs of SEQ ID NO:143 and the anti-ErbB3 VLCDR1, VLCDR2 and VLCDR3 of the PBA comprise the aa sequence of the corresponding CDRs of SEQ ID NO:175. In certain embodiments, the anti-ErbB3 VHCDR1, VHCDR2, VHCDR3 of a PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:169.

In certain embodiments, the anti-IGF-1R VHCDR1, VHCDR2, VHCDR3 of a PBA comprise the aa sequence of the corresponding CDRs of SEQ ID NO:8 and the anti-IGF-1R VLCDR1, VLCDR2 and VLCDR3 of the PBA comprise the aa sequence of the corresponding CDRs of SEQ ID NO:32; and (a) the anti-ErbB3 VHCDR1, VHCDR2, VHCDR3 of the PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166; or (b) the anti-ErbB3 VHCDR1, VHCDR2, VHCDR3 of the PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167; or (c) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168; or (d) the anti-ErbB3 VHCDR1, VHCDR2, VHCDR3 of the PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169; or (e) the anti-ErbB3 VHCDR1, VHCDR2, VHCDR3 of the PBA comprise the aa sequence of the corresponding CDRs of SEQ ID NO:138 and the anti-ErbB3 VLCDR1, VLCDR2 and VLCDR3 of the PBA comprise the aa sequence of the corresponding CDRs of SEQ ID NO:170; or (f) the anti-ErbB3 VHCDR1, VHCDR2, VHCDR3 of the PBA comprise the aa sequence of the corresponding CDRs of SEQ ID NO:139 and the anti-ErbB3 VLCDR1, VLCDR2 and VLCDR3 of the PBA comprise the aa sequence of the corresponding CDRs of SEQ ID NO:171; or (g) the anti-ErbB3 VHCDR1, VHCDR2, VHCDR3 of the PBA comprise the aa sequence of the corresponding CDRs of SEQ ID NO:140 and the anti-ErbB3 VLCDR1, VLCDR2 and VLCDR3 of the PBA comprise the aa sequence of the corresponding CDRs of SEQ ID NO:172; or (h) the anti-ErbB3 VHCDR1, VHCDR2, VHCDR3 of the PBA comprise the aa sequence of the corresponding CDRs of SEQ ID NO:141 and the anti-ErbB3 VLCDR1, VLCDR2 and VLCDR3 of the PBA comprise the aa sequence of the corresponding CDRs of SEQ ID NOs: 173; or (i) the anti-ErbB3 VHCDR1, VHCDR2, VHCDR3 of the PBA comprise the aa sequence of the corresponding CDRs of SEQ ID NO:142 and the anti-ErbB3 VLCDR1, VLCDR2 and VLCDR3 of the PBA comprise the aa sequence of the corresponding CDRs of SEQ ID NO:174; or (j) the anti-ErbB3 VHCDR1, VHCDR2, VHCDR3 of the PBA comprise the aa sequence of the corresponding CDRs of SEQ ID NO:143 and the anti-ErbB3 VLCDR1, VLCDR2 and VLCDR3 of the PBA comprise the aa sequence of the corresponding CDRs of SEQ ID NO:175; or (k) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:169.

In certain embodiments, the anti-IGF-1R VHCDR1, VHCDR2, VHCDR3 of a PBA comprise the aa sequence of the corresponding CDRs of SEQ ID NO:9 and the anti-IGF-1R VLCDR1, VLCDR2 and VLCDR3 of the PBA comprise the aa sequence of the corresponding CDRs of SEQ ID NO:33; and (a) the anti-ErbB3 VHCDR1, VHCDR2, VHCDR3 of the PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166; or (b) the anti-ErbB3 VHCDR1, VHCDR2, VHCDR3 of the PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167; or (c) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168; or (d) the anti-ErbB3 VHCDR1, VHCDR2, VHCDR3 of the PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169; or (e) the anti-ErbB3 VHCDR1, VHCDR2, VHCDR3 of the PBA comprise the aa sequence of the corresponding CDRs of SEQ ID NO:138 and the anti-ErbB3 VLCDR1, VLCDR2 and VLCDR3 of the PBA comprise the aa sequence of the corresponding CDRs of SEQ ID NO:170; or (f) the anti-ErbB3 VHCDR1, VHCDR2, VHCDR3 of the PBA comprise the aa sequence of the corresponding CDRs of SEQ ID NO:139 and the anti-ErbB3 VLCDR1, VLCDR2 and VLCDR3 of the PBA comprise the aa sequence of the corresponding CDRs of SEQ ID NO:171; or (g) the anti-ErbB3 VHCDR1, VHCDR2, VHCDR3 of the PBA comprise the aa sequence of the corresponding CDRs of SEQ ID NO:140 and the anti-ErbB3 VLCDR1, VLCDR2 and VLCDR3 of the PBA comprise the aa sequence of the corresponding CDRs of SEQ ID NO:172; or (h) the anti-ErbB3 VHCDR1, VHCDR2, VHCDR3 of the PBA comprise the aa sequence of the corresponding CDRs of SEQ ID NO:141 and the anti-ErbB3 VLCDR1, VLCDR2 and VLCDR3 of the PBA comprise the aa sequence of the corresponding CDRs of SEQ ID NOs: 173; or (i) the anti-ErbB3 VHCDR1, VHCDR2, VHCDR3 of the PBA comprise the aa sequence of the corresponding CDRs of SEQ ID NO:142 and the anti-ErbB3 VLCDR1, VLCDR2 and VLCDR3 of the PBA comprise the aa sequence of the corresponding CDRs of SEQ ID NO:174; or (j) the anti-ErbB3 VHCDR1, VHCDR2, VHCDR3 of the PBA comprise the aa sequence of the corresponding CDRs of SEQ ID NO:143 and the anti-ErbB3 VLCDR1, VLCDR2 and VLCDR3 of the PBA comprise the aa sequence of the corresponding CDRs of SEQ ID NO:175; or (k) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:169.

In certain embodiments, the anti-IGF-1R VHCDR1, VHCDR2, VHCDR3 of a PBA comprise the aa sequence of the corresponding CDRs of SEQ ID NO:10 and the anti-IGF-1R VLCDR1, VLCDR2 and VLCDR3 of the PBA comprise the aa sequence of the corresponding CDRs of SEQ ID NO:34; and (a) the anti-ErbB3 VHCDR1, VHCDR2, VHCDR3 of the PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166; or (b) the anti-ErbB3 VHCDR1, VHCDR2, VHCDR3 of the PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167; or (c) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168; or (d) the anti-ErbB3 VHCDR1, VHCDR2, VHCDR3 of the PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169; or (e) the anti-ErbB3 VHCDR1, VHCDR2, VHCDR3 of the PBA comprise the aa sequence of the corresponding CDRs of SEQ ID NO:138 and the anti-ErbB3 VLCDR1, VLCDR2 and VLCDR3 of the PBA comprise the aa sequence of the corresponding CDRs of SEQ ID NO:170; or (f) the anti-ErbB3 VHCDR1, VHCDR2, VHCDR3 of the PBA comprise the aa sequence of the corresponding CDRs of SEQ ID NO:139 and the anti-ErbB3 VLCDR1, VLCDR2 and VLCDR3 of the PBA comprise the aa sequence of the corresponding CDRs of SEQ ID NO:171; or (g) the anti-ErbB3 VHCDR1, VHCDR2, VHCDR3 of the PBA comprise the aa sequence of the corresponding CDRs of SEQ ID NO:140 and the anti-ErbB3 VLCDR1, VLCDR2 and VLCDR3 of the PBA comprise the aa sequence of the corresponding CDRs of SEQ ID NO:172; or (h) the anti-ErbB3 VHCDR1, VHCDR2, VHCDR3 of the PBA comprise the aa sequence of the corresponding CDRs of SEQ ID NO:141 and the anti-ErbB3 VLCDR1, VLCDR2 and VLCDR3 of the PBA comprise the aa sequence of the corresponding CDRs of SEQ ID NOs: 173; or (i) the anti-ErbB3 VHCDR1, VHCDR2, VHCDR3 of the PBA comprise the aa sequence of the corresponding CDRs of SEQ ID NO:142 and the anti-ErbB3 VLCDR1, VLCDR2 and VLCDR3 of the PBA comprise the aa sequence of the corresponding CDRs of SEQ ID NO:174; or (j) the anti-ErbB3 VHCDR1, VHCDR2, VHCDR3 of the PBA comprise the aa sequence of the corresponding CDRs of SEQ ID NO:143 and the anti-ErbB3 VLCDR1, VLCDR2 and VLCDR3 of the PBA comprise the aa sequence of the corresponding CDRs of SEQ ID NO:175; or (k) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:169.

In certain embodiments, the anti-IGF-1R VHCDR1, VHCDR2, VHCDR3 of a PBA comprise the aa sequence of the corresponding CDRs of SEQ ID NO:11 and the anti-IGF-1R VLCDR1, VLCDR2 and VLCDR3 of the PBA comprise the aa sequence of the corresponding CDRs of SEQ ID NO:35; and (a) the anti-ErbB3 VHCDR1, VHCDR2, VHCDR3 of the PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166; or (b) the anti-ErbB3 VHCDR1, VHCDR2, VHCDR3 of the PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167; or (c) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168; or (d) the anti-ErbB3 VHCDR1, VHCDR2, VHCDR3 of the PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169; or (e) the anti-ErbB3 VHCDR1, VHCDR2, VHCDR3 of the PBA comprise the aa sequence of the corresponding CDRs of SEQ ID NO:138 and the anti-ErbB3 VLCDR1, VLCDR2 and VLCDR3 of the PBA comprise the aa sequence of the corresponding CDRs of SEQ ID NO:170; or (f) the anti-ErbB3 VHCDR1, VHCDR2, VHCDR3 of the PBA comprise the aa sequence of the corresponding CDRs of SEQ ID NO:139 and the anti-ErbB3 VLCDR1, VLCDR2 and VLCDR3 of the PBA comprise the aa sequence of the corresponding CDRs of SEQ ID NO:171; or (g) the anti-ErbB3 VHCDR1, VHCDR2, VHCDR3 of the PBA comprise the aa sequence of the corresponding CDRs of SEQ ID NO:140 and the anti-ErbB3 VLCDR1, VLCDR2 and VLCDR3 of the PBA comprise the aa sequence of the corresponding CDRs of SEQ ID NO:172; or (h) the anti-ErbB3 VHCDR1, VHCDR2, VHCDR3 of the PBA comprise the aa sequence of the corresponding CDRs of SEQ ID NO:141 and the anti-ErbB3 VLCDR1, VLCDR2 and VLCDR3 of the PBA comprise the aa sequence of the corresponding CDRs of SEQ ID NOs: 173; or (i) the anti-ErbB3 VHCDR1, VHCDR2, VHCDR3 of the PBA comprise the aa sequence of the corresponding CDRs of SEQ ID NO:142 and the anti-ErbB3 VLCDR1, VLCDR2 and VLCDR3 of the PBA comprise the aa sequence of the corresponding CDRs of SEQ ID NO:174; or (j) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:169.

In certain embodiments, the anti-IGF-1R VHCDR1, VHCDR2, VHCDR3 of a PBA comprise the aa sequence of the corresponding CDRs of SEQ ID NO:8 and the anti-IGF-1R VLCDR1, VLCDR2 and VLCDR3 of the PBA comprise the aa sequence of the corresponding CDRs of SEQ ID NO:33; and (a) the anti-ErbB3 VHCDR1, VHCDR2, VHCDR3 of the PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166; or (b) the anti-ErbB3 VHCDR1, VHCDR2, VHCDR3 of the PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167; or (c) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168; or (d) the anti-ErbB3 VHCDR1, VHCDR2, VHCDR3 of the PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169; or (e) the anti-ErbB3 VHCDR1, VHCDR2, VHCDR3 of the PBA comprise the aa sequence of the corresponding CDRs of SEQ ID NO:138 and the anti-ErbB3 VLCDR1, VLCDR2 and In certain embodiments, the anti-IGF-1R VHCDR1, VHCDR2, VHCDR3 of a PBA comprise the aa sequence of the corresponding CDRs of SEQ ID NO:10 and the anti-IGF-1R VLCDR1, VLCDR2 and VLCDR3 of the PBA comprise the aa sequence of the corresponding CDRs of SEQ ID NO:32; and (a) the anti-ErbB3 VHCDR1, VHCDR2, VHCDR3 of the PBA comprise the aa sequence of the corresponding CDRs of SEQ ID NO:134 and the anti-ErbB3 VLCDR1, VLCDR2 and VLCDR3 of the PBA comprise the aa sequence of the corresponding CDRs of SEQ ID NO:166; or (b) the anti-ErbB3 VHCDR1, VHCDR2, VHCDR3 of the PBA comprise the aa sequence of the corresponding CDRs of SEQ ID NO:135 and the anti-ErbB3 VLCDR1, VLCDR2 and VLCDR3 of the PBA comprise the aa sequence of the corresponding CDRs of SEQ ID NO:167; or (c) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:168; or (d) the anti-ErbB3 VHCDR1, VHCDR2, VHCDR3 of the PBA comprise the aa sequence of the corresponding CDRs of SEQ ID NO:137 and the anti-ErbB3 VLCDR1, VLCDR2 and VLCDR3 of the PBA comprise the aa sequence of the corresponding CDRs of SEQ ID NO:169; or (e) the anti-ErbB3 VHCDR1, VHCDR2, VHCDR3 of the PBA comprise the aa sequence of the corresponding CDRs of SEQ ID NO:138 and the anti-ErbB3 VLCDR1, VLCDR2 and VLCDR3 of the PBA comprise the aa sequence of the corresponding CDRs of SEQ ID NO:170; or (f) the anti-ErbB3 VHCDR1, VHCDR2, VHCDR3 of the PBA comprise the aa sequence of the corresponding CDRs of SEQ ID NO:139 and the anti-ErbB3 VLCDR1, VLCDR2 and VLCDR3 of the PBA comprise the aa sequence of the corresponding CDRs of SEQ ID NO:171; or (g) the anti-ErbB3 VHCDR1, VHCDR2, VHCDR3 of the PBA comprise the aa sequence of the corresponding CDRs of SEQ ID NO:140 and the anti-ErbB3 VLCDR1, VLCDR2 and VLCDR3 of the PBA comprise the aa sequence of the corresponding CDRs of SEQ ID NO:172; or (h) the anti-ErbB3 VHCDR1, VHCDR2, VHCDR3 of the PBA comprise the aa sequence of the corresponding CDRs of SEQ ID NO:141 and the anti-ErbB3 VLCDR1, VLCDR2 and VLCDR3 of the PBA comprise the aa sequence of the corresponding CDRs of SEQ ID NOs: 173; or (i) the anti-ErbB3 VHCDR1, VHCDR2, VHCDR3 of the PBA comprise the aa sequence of the corresponding CDRs of SEQ ID NO:142 and the anti-ErbB3 VLCDR1, VLCDR2 and VLCDR3 of the PBA comprise the aa sequence of the corresponding CDRs of SEQ ID NO:174; or (j) the anti-ErbB3 VHCDR1, VHCDR2, VHCDR3 of the PBA comprise the aa sequence of the corresponding CDRs of SEQ ID NO:143 and the anti-ErbB3 VLCDR1, VLCDR2 and VLCDR3 of the PBA comprise the aa sequence of the corresponding CDRs of SEQ ID NO:175; or (k) the anti-ErbB3 VHCDR1, VHCDR2, VHCDR3 of the PBA comprise the aa sequence of the corresponding CDRs of SEQ ID NO:136 and the anti-ErbB3 VLCDR1, VLCDR2 and VLCDR3 of the PBA comprise the aa sequence of the corresponding CDRs of SEQ ID NO:169.

In certain embodiments, each anti-IGF-1R binding site of a PBA comprises a VH domain comprising the sequence of SEQ ID NO:1, wherein the sequence comprises variable aas, which independently represent any aa set forth at the corresponding position in FIG. 1 and/or each anti-IGF-1R binding site of a PBA comprises a VL domain comprising the sequence of SEQ ID NO:2 (or 3), wherein the sequence comprises variable aas, which independently represent any aa set forth at the corresponding position in FIG. 2.

In certain embodiments, each anti-ErbB3 binding site of a PBA comprises a VH domain comprising the sequence of SEQ ID NO:4 (or 5), wherein the sequence comprises variable aas, which independently represent any aa set forth at the corresponding position in FIG. 3 and/or each anti-ErbB3 binding site of a PBA comprises a VL domain comprising the sequence of SEQ ID NO:6 (or 7), wherein the sequence comprises variable aas, which independently represent any aa set forth at the corresponding position in FIG. 4.

In certain embodiments, each anti-IGF-1R binding site of a PBA comprises a VH domain comprising the sequence of SEQ ID NO:1 and a VL domain comprising the sequence of SEQ ID NO:2 (or 3) and each anti-ErbB3 binding site of the PBA comprises a VH domain comprising the sequence of SEQ ID NO:4 (or 5) and a VL domain comprising the sequence of SEQ ID NO:6 (or 7).

In certain embodiments, each anti-IGF-1R binding site of a PBA comprises a VH domain comprising the aa sequence of SEQ ID NO:1, wherein X1 is not T, X2 is not V, X6 is not R, X8 is not D or X10 is not I, or a VL domain comprising the aa sequence of SEQ ID NO:3 or each anti-ErbB3 binding site of a PBA comprises a VH domain comprising the aa sequence of SEQ ID NO:5 or a VL domain comprising the sequence of SEQ ID NO:7. In certain embodiments, each anti-IGF-1R binding site of a PBA comprises a VH domain comprising the aa sequence of SEQ ID NO:1, wherein X1 is not T, X2 is not V, X6 is not R, X8 is not D or X10 is not I, a VL domain comprising the sequence of SEQ ID NO:3; and each anti-ErbB3 binding site of the PBA comprises a VH domain comprising the aa sequence of SEQ ID NO:5 and a VL domain comprising the sequence of SEQ ID NO:7.

In certain embodiments, each anti-IGF-1R binding site of a PBA comprises a VH domain comprising an aa sequence selected from the group consisting of SEQ ID NOs: 8-31 and/or a VL domain comprising an aa sequence selected from the group consisting of SEQ ID NOs: 32-133 and/or each anti-ErbB3 binding site comprises a VH aa sequence selected from the group consisting of SEQ ID NOs: 134-165; and/or a VL aa sequence selected from the group consisting of SEQ ID NOs: 166-200. In certain embodiments, (a) each first VH domain comprises an aa sequence selected from the group comprising SEQ ID NOs: 8-31, each first VL domain comprises an aa sequence selected from the group consisting of SEQ ID NOs: 32-133, each second VH domain comprises an aa sequence selected from the group consisting of SEQ ID NOs: 134-165 and each second VL domain comprises an aa sequence selected from the group comprising SEQ ID NOs: 166-200, or (b) each first VH domain comprises an aa sequence selected from the group comprising SEQ ID NOs: 134-165, each first VL domain comprises an aa sequence selected from the group consisting of SEQ ID NOs: 166-200, each second VH domain comprises an aa sequence selected from the group comprising SEQ ID NOs: 8-31 and each second VL domain consisting of an aa sequence selected from the group comprising SEQ ID NOs: 32-133.

In certain embodiments, each anti-IGF-1R VH domain of a PBA comprises the aa sequence of SEQ ID NO:8 and each anti-IGF-1R VL domain of the PBA comprises the aa sequence of SEQ ID NO:32. In certain embodiments, each anti-IGF-1R VH domain of a PBA comprises the aa sequence of SEQ ID NO:9 and each anti-IGF-1R VL domain of the PBA comprises the aa sequence of SEQ ID NO:33. In certain embodiments, each anti-IGF-1R VH domain of a PBA comprises the aa sequence of SEQ ID NO:10 and each anti-IGF-1R VL domain of the PBA comprises the aa sequence of SEQ ID NO:34. In certain embodiments, each anti-IGF-1R VH domain of a PBA comprises the aa sequence of SEQ ID NO:11 and each anti-IGF-1R VL domain of the PBA comprises the aa sequence of SEQ ID NO:35. In certain embodiments, each anti-IGF-1R VH domain of a PBA comprises the aa sequence of SEQ ID NO:8 and each anti-IGF-1R VL domain of the PBA comprises the aa sequence of SEQ ID NO:33. In certain embodiments, each anti-IGF-1R VH domain of a PBA comprises the aa sequence of SEQ ID NO:10 and each anti-IGF-1R VL domain of the PBA comprises the aa sequence of SEQ ID NO:32.

In certain embodiments, each anti-ErbB3 VH domain of a PBA comprises the aa sequence of SEQ ID NO:134 and each anti-ErbB3 VL domain of the PBA comprises the aa sequence of SEQ ID NO:166. In certain embodiments, each anti-ErbB3 VH domain of a PBA comprises the aa sequence of SEQ ID NO:135 and the anti-ErbB3 VL domain of the PBA comprise the aa sequence of SEQ ID NO:167. In certain embodiments, each anti-ErbB3 VH domain of a PBA comprises the aa sequence of SEQ ID NO:136 and each anti-ErbB3 VL domain of the PBA comprises the aa sequence of SEQ ID NO:168. In certain embodiments, each anti-ErbB3 VH domain of a PBA comprises the aa sequence of SEQ ID NO:137 and each anti-ErbB3 VL domain of the PBA comprises the aa sequence of SEQ ID NO:169. In certain embodiments, each anti-ErbB3 VH domain of a PBA comprises the aa sequence of SEQ ID NO:138 and each anti-ErbB3 VL domain of the PBA comprises the aa sequence of SEQ ID NO:170. In certain embodiments, each anti-ErbB3 VH domain of a PBA comprises the aa sequence of SEQ ID NO:139 and each anti-ErbB3 VL domain of the PBA comprises the aa sequence of SEQ ID NO:171. In certain embodiments, each anti-ErbB3 VH domain of a PBA comprises the aa sequence of SEQ ID NO:140 and each anti-ErbB3 VL domain of the PBA comprises the aa sequence of SEQ ID NO:172. In certain embodiments, each anti-ErbB3 VH domain of a PBA comprises the aa sequence of SEQ ID NO:141 and each anti-ErbB3 VL domain of the PBA comprises the aa sequence of SEQ ID NO:173. In certain embodiments, each anti-ErbB3 VH domain of a PBA comprises the aa sequence of SEQ ID NO:142 and each anti-ErbB3 VL domain of the PBA comprises the aa sequence of SEQ ID NO:174. In certain embodiments, each anti-ErbB3 VH domain of a PBA comprises the aa sequence of SEQ ID NO:143 and each anti-ErbB3 VL domain of the PBA comprises the aa sequence of SEQ ID NO:175. In certain embodiments, each anti-ErbB3 VH domain of a PBA comprises the aa sequence of SEQ ID NO:136 and each anti-ErbB3 VL domain of the PBA comprises the aa sequence of SEQ ID NOs: 169.

In certain embodiments, each anti-IGF-1R VH domain of a PBA comprises the aa sequence of SEQ ID NO:8 and each anti-IGF-1R VL domain of the PBA comprises the aa sequence of SEQ ID NO:32; and (a) each anti-ErbB3 VH domain of the PBA comprises the aa sequence of SEQ ID NO:134 and each anti-ErbB3 VL domain of the PBA comprises the aa sequence of SEQ ID NO:166; or (b) each anti-ErbB3 VH domain of the PBA comprises the aa sequence of SEQ ID NO:135 and the anti-ErbB3 VL domain of the PBA comprise the aa sequence of SEQ ID NO:167; or (c) each anti-ErbB3 VH domain of the PBA comprises the aa sequence of SEQ ID NO:136 and each anti-ErbB3 VL domain of the PBA comprises the aa sequence of SEQ ID NO:168; or (d) each anti-ErbB3 VH domain of the PBA comprises the aa sequence of SEQ ID NO:137 and each anti-ErbB3 VL domain of the PBA comprises the aa sequence of SEQ ID NO:169; or (e) each anti-ErbB3 VH domain of the PBA comprises the aa sequence of SEQ ID NO:138 and each anti-ErbB3 VL domain of the PBA comprises the aa sequence of SEQ ID NO:170; or (f) each anti-ErbB3 VH domain of the PBA comprises the aa sequence of SEQ ID NO:139 and each anti-ErbB3 VL domain of the PBA comprises the aa sequence of SEQ ID NO:171; or (g) each anti-ErbB3 VH domain of the PBA comprises the aa sequence of SEQ ID NO:140 and each anti-ErbB3 VL domain of the PBA comprises the aa sequence of SEQ ID NO:172; or (h) each anti-ErbB3 VH domain of the PBA comprises the aa sequence of SEQ ID NO:141 and each anti-ErbB3 VL domain of the PBA comprises the aa sequence of SEQ ID NO:173; or (i) each anti-ErbB3 VH domain of the PBA comprises the aa sequence of SEQ ID NO:142 and each anti-ErbB3 VL domain of the PBA comprises the aa sequence of SEQ ID NO:174; or (j) each anti-ErbB3 VH domain of the PBA comprises the aa sequence of SEQ ID NO:143 and each anti-ErbB3 VL domain of the PBA comprises the aa sequence of SEQ ID NO:175; or (k) each anti-ErbB3 VH domain of the PBA comprises the aa sequence of SEQ ID NO:136 and each anti-ErbB3 VL domain of the PBA comprises the aa sequence of SEQ ID NOs: 169.

In certain embodiments, each anti-IGF-1R VH domain of a PBA comprises the aa sequence of SEQ ID NO:9 and each anti-IGF-1R VL domain of the PBA comprises the aa sequence of SEQ ID NO:33; and (a) each anti-ErbB3 VH domain of the PBA comprises the aa sequence of SEQ ID NO:134 and each anti-ErbB3 VL domain of the PBA comprises the aa sequence of SEQ ID NO:166; or (b) each anti-ErbB3 VH domain of the PBA comprises the aa sequence of SEQ ID NO:135 and the anti-ErbB3 VL domain of the PBA comprise the aa sequence of SEQ ID NO:167; or (c) each anti-ErbB3 VH domain of the PBA comprises the aa sequence of SEQ ID NO:136 and each anti-ErbB3 VL domain of the PBA comprises the aa sequence of SEQ ID NO:168; or (d) each anti-ErbB3 VH domain of the PBA comprises the aa sequence of SEQ ID NO:137 and each anti-ErbB3 VL domain of the PBA comprises the aa sequence of SEQ ID NO:169; or (e) each anti-ErbB3 VH domain of the PBA comprises the aa sequence of SEQ ID NO:138 and each anti-ErbB3 VL domain of the PBA comprises the aa sequence of SEQ ID NO:170; or (f) each anti-ErbB3 VH domain of the PBA comprises the aa sequence of SEQ ID NO:139 and each anti-ErbB3 VL domain of the PBA comprises the aa sequence of SEQ ID NO:171; or (g) each anti-ErbB3 VH domain of the PBA comprises the aa sequence of SEQ ID NO:140 and each anti-ErbB3 VL domain of the PBA comprises the aa sequence of SEQ ID NO:172; or (h) each anti-ErbB3 VH domain of the PBA comprises the aa sequence of SEQ ID NO:141 and each anti-ErbB3 VL domain of the PBA comprises the aa sequence of SEQ ID NO:173; or (i) each anti-ErbB3 VH domain of the PBA comprises the aa sequence of SEQ ID NO:142 and each anti-ErbB3 VL domain of the PBA comprises the aa sequence of SEQ ID NO:174; or (j) each anti-ErbB3 VH domain of the PBA comprises the aa sequence of SEQ ID NO:143 and each anti-ErbB3 VL domain of the PBA comprises the aa sequence of SEQ ID NO:175; or (k) each anti-ErbB3 VH domain of the PBA comprises the aa sequence of SEQ ID NO:136 and each anti-ErbB3 VL domain of the PBA comprises the aa sequence of SEQ ID NOs: 169.

In certain embodiments, each anti-IGF-1R VH domain comprises the aa sequence of SEQ ID NO:10 and each anti-IGF-1R VL domain comprises the aa sequence of SEQ ID NO:34; and (a) each anti-ErbB3 VH domain of the PBA comprises the aa sequence of SEQ ID NO:134 and each anti-ErbB3 VL domain of the PBA comprises the aa sequence of SEQ ID NO:166; or (b) each anti-ErbB3 VH domain of the PBA comprises the aa sequence of SEQ ID NO:135 and the anti-ErbB3 VL domain of the PBA comprise the aa sequence of SEQ ID NO:167; or (c) each anti-ErbB3 VH domain of the PBA comprises the aa sequence of SEQ ID NO:136 and each anti-ErbB3 VL domain of the PBA comprises the aa sequence of SEQ ID NO:168; or (d) each anti-ErbB3 VH domain of the PBA comprises the aa sequence of SEQ ID NO:137 and each anti-ErbB3 VL domain of the PBA comprises the aa sequence of SEQ ID NO:169; or (e) each anti-ErbB3 VH domain of the PBA comprises the aa sequence of SEQ ID NO:138 and each anti-ErbB3 VL domain of the PBA comprises the aa sequence of SEQ ID NO:170; or (f) each anti-ErbB3 VH domain of the PBA comprises the aa sequence of SEQ ID NO:139 and each anti-ErbB3 VL domain of the PBA comprises the aa sequence of SEQ ID NO:171; or (g) each anti-ErbB3 VH domain of the PBA comprises the aa sequence of SEQ ID NO:140 and each anti-ErbB3 VL domain of the PBA comprises the aa sequence of SEQ ID NO:172; or (h) each anti-ErbB3 VH domain of the PBA comprises the aa sequence of SEQ ID NO:141 and each anti-ErbB3 VL domain of the PBA comprises the aa sequence of SEQ ID NO:173; or (i) each anti-ErbB3 VH domain of the PBA comprises the aa sequence of SEQ ID NO:142 and each anti-ErbB3 VL domain of the PBA comprises the aa sequence of SEQ ID NO:174; or (j) each anti-ErbB3 VH domain of the PBA comprises the aa sequence of SEQ ID NO:143 and each anti-ErbB3 VL domain of the PBA comprises the aa sequence of SEQ ID NO:175; or (k) each anti-ErbB3 VH domain of the PBA comprises the aa sequence of SEQ ID NO:136 and each anti-ErbB3 VL domain of the PBA comprises the aa sequence of SEQ ID NOs: 169.

In certain embodiments, each anti-IGF-1R VH domain of a PBA comprises the aa sequence of SEQ ID NO:11 and each anti-IGF-1R VL domain of the PBA comprises the aa sequence of SEQ ID NO:35; and (a) each anti-ErbB3 VH domain of the PBA comprises the aa sequence of SEQ ID NO:134 and each anti-ErbB3 VL domain of the PBA comprises the aa sequence of SEQ ID NO:166; or (b) each anti-ErbB3 VH domain of the PBA comprises the aa sequence of SEQ ID NO:135 and the anti-ErbB3 VL domain of the PBA comprise the aa sequence of SEQ ID NO:167; or (c) each anti-ErbB3 VH domain of the PBA comprises the aa sequence of SEQ ID NO:136 and each anti-ErbB3 VL domain of the PBA comprises the aa sequence of SEQ ID NO:168; or (d) each anti-ErbB3 VH domain of the PBA comprises the aa sequence of SEQ ID NO:137 and each anti-ErbB3 VL domain of the PBA comprises the aa sequence of SEQ ID NO:169; or (e) each anti-ErbB3 VH domain of the PBA comprises the aa sequence of SEQ ID NO:138 and each anti-ErbB3 VL domain of the PBA comprises the aa sequence of SEQ ID NO:170; or (f) each anti-ErbB3 VH domain of the PBA comprises the aa sequence of SEQ ID NO:139 and each anti-ErbB3 VL domain of the PBA comprises the aa sequence of SEQ ID NO:171; or (g) each anti-ErbB3 VH domain of the PBA comprises the aa sequence of SEQ ID NO:140 and each anti-ErbB3 VL domain of the PBA comprises the aa sequence of SEQ ID NO:172; or (h) each anti-ErbB3 VH domain of the PBA comprises the aa sequence of SEQ ID NO:141 and each anti-ErbB3 VL domain of the PBA comprises the aa sequence of SEQ ID NO:173; or (i) each anti-ErbB3 VH domain of the PBA comprises the aa sequence of SEQ ID NO:142 and each anti-ErbB3 VL domain of the PBA comprises the aa sequence of SEQ ID NO:174; or (j) each anti-ErbB3 VH domain of the PBA comprises the aa sequence of SEQ ID NO:136 and each anti-ErbB3 VL domain of the PBA comprises the aa sequence of SEQ ID NOs: 169.

In certain embodiments, each anti-IGF-1R VH domain of the PBA comprises the aa sequence of SEQ ID NO:8 and each anti-IGF-1R VL domain of the PBA comprises the aa sequence of SEQ ID NO:33; and (a) each anti-ErbB3 VH domain of the PBA comprises the aa sequence of SEQ ID NO:134 and each anti-ErbB3 VL domain of the PBA comprises the aa sequence of SEQ ID NO:166; or (b) each anti-ErbB3 VH domain of the PBA comprises the aa sequence of SEQ ID NO:135 and the anti-ErbB3 VL domain of the PBA comprise the aa sequence of SEQ ID NO:167; or (c) each anti-ErbB3 VH domain of the PBA comprises the aa sequence of SEQ ID NO:136 and each anti-ErbB3 VL domain of the PBA comprises the aa sequence of SEQ ID NO:168; or (d) each anti-ErbB3 VH domain of the PBA comprises the aa sequence of SEQ ID NO:137 and each anti-ErbB3 VL domain of the PBA comprises the aa sequence of SEQ ID NO:169; or (e) each anti-ErbB3 VH domain of the PBA comprises the aa sequence of SEQ ID NO:138 and each anti-ErbB3 VL domain of the PBA comprises the aa sequence of SEQ ID NO:170; or (f) each anti-ErbB3 VH domain of the PBA comprises the aa sequence of SEQ ID NO:139 and each anti-ErbB3 VL domain of the PBA comprises the aa sequence of SEQ ID NO:171; or (g) each anti-ErbB3 VH domain of the PBA comprises the aa sequence of SEQ ID NO:140 and each anti-ErbB3 VL domain of the PBA comprises the aa sequence of SEQ ID NO:172; or (h) each anti-ErbB3 VH domain of the PBA comprises the aa sequence of SEQ ID NO:141 and each anti-ErbB3 VL domain of the PBA comprises the aa sequence of SEQ ID NO:173; or (i) each anti-ErbB3 VH domain of the PBA comprises the aa sequence of SEQ ID NO:142 and each anti-ErbB3 VL domain of the PBA comprises the aa sequence of SEQ ID NO:174; or (j) each anti-ErbB3 VH domain of the PBA comprises the aa sequence of SEQ ID NO:143 and each anti-ErbB3 VL domain of the PBA comprises the aa sequence of SEQ ID NO:175; or (k) each anti-ErbB3 VH domain of the PBA comprises the aa sequence of SEQ ID NO:136 and each anti-ErbB3 VL domain of the PBA comprises the aa sequence of SEQ ID NOs: 169.

In certain embodiments, each anti-IGF-1R VH domain of a PBA comprises the aa sequence of SEQ ID NO:10 and each anti-IGF-1R VL domain of the PBA comprises the aa sequence of SEQ ID NO:32; and (a) each anti-ErbB3 VH domain of the PBA comprises the aa sequence of SEQ ID NO:134 and each anti-ErbB3 VL domain of the PBA comprises the aa sequence of SEQ ID NO:166; or (b) each anti-ErbB3 VH domain of the PBA comprises the aa sequence of SEQ ID NO:135 and the anti-ErbB3 VL domain of the PBA comprise the aa sequence of SEQ ID NO:167; or (c) each anti-ErbB3 VH domain of the PBA comprises the aa sequence of SEQ ID NO:136 and each anti-ErbB3 VL domain of the PBA comprises the aa sequence of SEQ ID NO:168; or (d) each anti-ErbB3 VH domain of the PBA comprises the aa sequence of SEQ ID NO:137 and each anti-ErbB3 VL domain of the PBA comprises the aa sequence of SEQ ID NO:169; or (e) each anti-ErbB3 VH domain of the PBA comprises the aa sequence of SEQ ID NO:138 and each anti-ErbB3 VL domain of the PBA comprises the aa sequence of SEQ ID NO:170; or (f) each anti-ErbB3 VH domain of the PBA comprises the aa sequence of SEQ ID NO:139 and each anti-ErbB3 VL domain of the PBA comprises the aa sequence of SEQ ID NO:171; or (g) each anti-ErbB3 VH domain of the PBA comprises the aa sequence of SEQ ID NO:140 and each anti-ErbB3 VL domain of the PBA comprises the aa sequence of SEQ ID NO:172; or (h) each anti-ErbB3 VH domain of the PBA comprises the aa sequence of SEQ ID NO:141 and each anti-ErbB3 VL domain of the PBA comprises the aa sequence of SEQ ID NO:173; or (i) each anti-ErbB3 VH domain of the PBA comprises the aa sequence of SEQ ID NO:142 and each anti-ErbB3 VL domain of the PBA comprises the aa sequence of SEQ ID NO:174; or (j) each anti-ErbB3 VH domain of the PBA comprises the aa sequence of SEQ ID NO:143 and each anti-ErbB3 VL domain of the PBA comprises the aa sequence of SEQ ID NO:175; or (k) each anti-ErbB3 VH domain of the PBA comprises the aa sequence of SEQ ID NO:136 and each anti-ErbB3 VL domain of the PBA comprises the aa sequence of SEQ ID NOs: 169.

In certain embodiments, (a) each heavy chain of a PBA comprises an aa sequence selected from the group consisting of SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256) and/or each light chain of the PBA comprises an aa sequence selected from the group consisting of SF kappa light chain (SEQ ID NO:202); P4 kappa light chain (SEQ ID NO:204); M78 kappa light chain (SEQ ID NO:206); and M57 kappa light chain (SEQ ID NO:208); or (b) each heavy chain of a PBA comprises an aa sequence selected from the group comprising P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); B60-G1-M78 (SEQ ID NO:296); B60-G2-M78 (SEQ ID NO:355) and M7-G2-M78 (SEQ ID NO:357) and/or each light chain of the PBA comprises an aa sequence selected from the group consisting of P1 lambda light chain (SEQ ID NO:258); M27 lambda light chain (SEQ ID NO:260); M7 lambda light chain (SEQ ID NO:262); B72 lambda light chain (SEQ ID NO:264); and B60 lambda light chain (SEQ ID NO:266).

In certain embodiments, (a) each heavy chain of a PBA comprises an aa sequence differing in at least one aa addition, deletion or substitution from an aa sequence selected from the group consisting of SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256) and each light chain of the PBA comprises an aa sequence selected from the group consisting of SF kappa light chain (SEQ ID NO:202); P4 kappa light chain (SEQ ID NO:204); M78 kappa light chain (SEQ ID NO:206); and M57 kappa light chain (SEQ ID NO:208); or (b) each heavy chain of a PBA comprises an aa sequence selected from the group consisting of SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256); and each light chain of the PBA comprises an aa sequence differing in at least one aa addition, deletion or substitution from an aa sequence selected from the group consisting of SF kappa light chain (SEQ ID NO:202); P4 kappa light chain (SEQ ID NO:204); M78 kappa light chain (SEQ ID NO:206); and M57 kappa light chain (SEQ ID NO:208); or (c) each heavy chain of a PBA comprises an aa sequence differing in at least one aa addition, deletion or substitution from an aa sequence selected from the group comprising P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); B60-G1-M78 (SEQ ID NO:296); B60-G2-M78 (SEQ ID NO:355) and M7-G2-M78 (SEQ ID NO:357) and each light chain of the PBA comprises an aa sequence selected from the group consisting of P1 lambda light chain (SEQ ID NO:258); M27 lambda light chain (SEQ ID NO:260); M7 lambda light chain (SEQ ID NO:262); B72 lambda light chain (SEQ ID NO:264); and B60 lambda light chain (SEQ ID NO:266); or (d) each heavy chain of a PBA comprises an aa sequence selected from the group comprising P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); B60-G1-M78 (SEQ ID NO:296); B60-G2-M78 (SEQ ID NO:355) and M7-G2-M78 (SEQ ID NO:357) and each light chain of the PBA comprises an aa sequence differing in at least one aa addition, deletion or substitution from an aa sequence selected from the group consisting of P1 lambda light chain (SEQ ID NO:258); M27 lambda light chain (SEQ ID NO:260); M7 lambda light chain (SEQ ID NO:262); B72 lambda light chain (SEQ ID NO:264); and B60 lambda light chain (SEQ ID NO:266), wherein the PBA differs from 16F in at least one aa, CDR or variable domain.

In certain embodiments, (a) each heavy chain of a PBA, bound to the other heavy chain of the PBA by at least one bond, comprises an aa sequence that is at least 90% identical to one of the following aa sequences or differs from one of the following aa sequences in 1-30 aa substitutions, deletions and/or additions: SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256) and (b) each light chain of the PBA, bound to one heavy chain of (a) by at least one bond, comprises an aa sequence that is at least 90% identical to one of the following aa sequences or differs from one of the following aa sequences in 1-30 aa substitutions, deletions and/or additions: SF kappa light chain (SEQ ID NO:202); P4 kappa light chain (SEQ ID NO:204); M78 kappa light chain (SEQ ID NO:206); and M57 kappa light chain (SEQ ID NO:208); or (c) each heavy chain of a PBA, bound to the other heavy chain of the PBA by at least one bond, comprises an aa sequence that is at least 90% identical to one of the following aa sequences or differs from one of the following aa sequences in 1-30 aa substitutions, deletions and/or additions: P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); and B60-G1-M78 (SEQ ID NO:296)); B60-G2-M78 (SEQ ID NO:355) and M7-G2-M78 (SEQ ID NO:357) and (d) each light chain of the PBA, bound to one heavy chain of (c) by at least one bond, comprises an aa sequence that is at least 90% identical to one of the following aa sequences or which differs from one of the following aa sequences in 1-30 aa substitutions, deletions and/or additions: P1 lambda light chain (SEQ ID NO:258); M27 lambda light chain (SEQ ID NO:260); M7 lambda light chain (SEQ ID NO:262); B72 lambda light chain (SEQ ID NO:264); and B60 lambda light chain (SEQ ID NO:266).

In certain embodiments, (a) each heavy chain of a PBA comprises an aa sequence that is at least 95% identical to one of the following aa sequence or differs from one of the following aa sequences in 1-10 aa substitutions, deletions and/or additions: SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256), and (b) each light chain of the PBA comprises an aa sequence that is at least 95% identical to one of the following aa sequences or differs from one of the following aa sequences in 1-10 aa substitutions, deletions and/or additions: SF kappa light chain (SEQ ID NO:202); P4 kappa light chain (SEQ ID NO:204); M78 kappa light chain (SEQ ID NO:206); and M57 kappa light chain (SEQ ID NO:208); or (c) each heavy chain of a PBA comprises an aa sequence that is at least 95% identical to one of the following aa sequences or differs from one of the following aa sequences in 1-10 aa substitutions, deletions and/or additions: P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); and B60-G1-M78 (SEQ ID NO:296); B60-G2-M78 (SEQ ID NO:355) and M7-G2-M78 (SEQ ID NO:357) and (d) each light chain of the PBA comprises an aa sequence that is at least 95% identical to one of the following aa sequences or differs from one of the following aa sequences in 1-10 aa substitutions, deletions and/or additions: P1 lambda light chain (SEQ ID NO:258); M27 lambda light chain (SEQ ID NO:260); M7 lambda light chain (SEQ ID NO:262); B72 lambda light chain (SEQ ID NO:264); B60 lambda light chain (SEQ ID NO:266).

Exemplary PBA include the following: (a) an SF-G1-P1 PBA comprising: two heavy chains, each comprising a heavy chain aa sequence of SEQ ID NO:212; and two light chains, each comprising a light chain sequence of SEQ ID NO:202; (b) An SF-G1-M1.3 PBA comprising: two heavy chains, each comprising a heavy chain aa sequence of SEQ ID NO:214; and two light chains, each comprising a light chain aa sequence of SEQ ID NO:202; (c) an SF-G1-M27 PBA comprising: two heavy chains, each comprising a heavy chain aa sequence of SEQ ID NO:216; and two light chains, each comprising a light chain aa sequence of SEQ ID NO:202; (d) an SF-G1-P6 PBA comprising: two heavy chains, each comprising a heavy chain aa sequence of SEQ ID NO:218; and two light chains, each comprising a light chain aa sequence of SEQ ID NO:202; (e) an SF-G1-B69 PBA comprising: two heavy chains, each comprising a heavy chain aa sequence of SEQ ID NO:220; and two light chains, each comprising a light chain aa sequence of SEQ ID NO:202; (f) a P4-G1-C8 PBA comprising: two heavy chains, each comprising a heavy chain aa sequence of SEQ ID NO:222; and two light chains, each comprising a light chain aa sequence of SEQ ID NO:204 (g) a P4-G1-P1 PBA comprising: two heavy chains, each comprising a heavy chain aa sequence of SEQ ID NO:224; and two light chains, each comprising a light chain aa sequence of SEQ ID NO:204; (h) a P4-G1-M1.3 PBA comprising: two heavy chains, each comprising a heavy chain aa sequence of SEQ ID NO:226; and two light chains, each comprising a light chain aa sequence of SEQ ID NO:204; (i) a P4-G1-M27 PBA comprising: two heavy chains, each comprising a heavy chain aa sequence of SEQ ID NO:228; and two light chains, each comprising a light chain aa sequence of SEQ ID NO:204; (j) a P4-G1-P6 PBA comprising: two heavy chains, each comprising a heavy chain aa sequence of SEQ ID NO:230; and two light chains, each comprising a light chain aa sequence of SEQ ID NO:204; (h) a P4-G1-B69 PBA comprising: two heavy chains, each comprising a heavy chain aa sequence of SEQ ID NO:232; and two light chains, each comprising a light chain aa sequence of SEQ ID NO:204; (i) an M78-G1-C8 PBA comprising: two heavy chains, each comprising a heavy chain aa sequence of SEQ ID NO:234; and two light chains, each comprising a light chain aa sequence of SEQ ID NO:206; (j) an M78-G1-P1 PBA comprising: two heavy chains, each comprising a heavy chain aa sequence of SEQ ID NO:236; and two light chains, each comprising a light chain aa sequence of SEQ ID NO:206; (k) an M78-G1-M1.3 PBA comprising: two heavy chains, each comprising a heavy chain aa sequence of SEQ ID NO:238; and two light chains, each comprising a light chain aa sequence of SEQ ID NO:206; (l) an M78-G1-M27 PBA comprising: two heavy chains, each comprising a heavy chain aa sequence of SEQ ID NO:240; and two light chains, each comprising a light chain aa sequence of SEQ ID NO:206; (m) an M78-G1-P6 PBA comprising: two heavy chains, each comprising a heavy chain aa sequence of SEQ ID NO:242; and two light chains, each comprising a light chain aa sequence of SEQ ID NO:206; (n) an M78-G1-B69 PBA comprising: two heavy chains, each comprising a heavy chain aa sequence of SEQ ID NO:244; and two light chains, each comprising a light chain aa sequence of SEQ ID NO:206; (o) an M57-G1-C8 PBA comprising: two heavy chains, each comprising a heavy chain aa sequence of SEQ ID NO:246; and two light chains, each comprising a light chain aa sequence of SEQ ID NO:208; (p) an M57-G1-P1 PBA comprising: two heavy chains, each comprising a heavy chain aa sequence of SEQ ID NO:248; and two light chains, each comprising a light chain aa sequence of SEQ ID NO:208; (r) an M57-G1-M1.3 PBA comprising: two heavy chains, each comprising a heavy chain aa sequence of SEQ ID NO:250; and two light chains, each comprising a light chain aa sequence of SEQ ID NO:208; (s) an M57-G1-M27 PBA comprising: two heavy chains, each comprising a heavy chain aa sequence of SEQ ID NO:252; and two light chains, each comprising a light chain aa sequence of SEQ ID NO:208; (t) an M57-G1-P6 PBA comprising: two heavy chains, each comprising a heavy chain aa sequence of SEQ ID NO:254; and two light chains, each comprising a light chain aa sequence of SEQ ID NO:208; (u) an M57-G1-B69 PBA comprising: two heavy chains, each comprising a heavy chain aa sequence of SEQ ID NO:256; and two light chains, each comprising a light chain aa sequence of SEQ ID NO:208; (v) a P1-G1-P4 PBA comprising: two heavy chains, each comprising a heavy chain aa sequence of SEQ ID NO:268; and two light chains, each comprising a light chain aa sequence of SEQ ID NO:258; (w) a P1-G1-M57 PBA comprising: two heavy chains, each comprising a heavy chain aa sequence of SEQ ID NO:270; and two light chains, each comprising a light chain aa sequence of SEQ ID NO:258; (x) a P1-G1-M78 PBA comprising: two heavy chains, each comprising a heavy chain aa sequence of SEQ ID NO:272; and two light chains, each comprising a light chain aa sequence of SEQ ID NO:258; (y) an M27-G1-P4 PBA comprising: two heavy chains, each comprising a heavy chain aa sequence of SEQ ID NO:274; and two light chains, each comprising a light chain aa sequence of SEQ ID NO:260; (z) an M27-G1-M57 PBA comprising: two heavy chains, each comprising a heavy chain aa sequence of SEQ ID NO:276; and two light chains, each comprising a light chain aa sequence of SEQ ID NO:260; (aa) an M27-G1-M78 PBA comprising: two heavy chains, each comprising a heavy chain aa sequence of SEQ ID NO:278; and two light chains, each comprising a light chain aa sequence of SEQ ID NO:260; (ab) an M7-G1-P4 PBA comprising: two heavy chains, each comprising a heavy chain aa sequence of SEQ ID NO:280; and two light chains, each comprising a light chain aa sequence of SEQ ID NO:262; (ac) an M7-G1-M57 PBA comprising: two heavy chains, each comprising a heavy chain aa sequence of SEQ ID NO:282; and two light chains, each comprising a light chain aa sequence of SEQ ID NO:262; (ad) an M7-G1-M78 PBA comprising: two heavy chains, each comprising a heavy chain aa sequence of SEQ ID NO:284; and two light chains, each comprising a light chain aa sequence of SEQ ID NO:262; (ae) a B72-G1-P4 PBA comprising: two heavy chains, each comprising a heavy chain aa sequence of SEQ ID NO:286; and two light chains, each comprising a light chain aa sequence of SEQ ID NO:264; (af) a B72-G1-M57 PBA comprising: two heavy chains, each comprising a heavy chain aa sequence of SEQ ID NO:288; and two light chains, each comprising a light chain aa sequence of SEQ ID NO:264; (ag) a B72-G1-M78 PBA comprising: two heavy chains, each comprising a heavy chain aa sequence of SEQ ID NO:290; and two light chains, each comprising a light chain aa sequence of SEQ ID NO:264; (ah) a B60-G1-P4 PBA comprising: two heavy chains, each comprising a heavy chain aa sequence of SEQ ID NO:292; and two light chains, each comprising a light chain aa sequence of SEQ ID NO:266; (ai) a B60-G1-M57 PBA comprising: two heavy chains, each comprising a heavy chain aa sequence of SEQ ID NO:294; and two light chains, each comprising a light chain aa sequence of SEQ ID NO:266; and (aj) a B60-G1-M78 PBA comprising: two heavy chains, each comprising a heavy chain aa sequence of SEQ ID NO:296; and two light chains, each comprising a light chain aa sequence of SEQ ID NO:266.

Also provided herein are monospecific antibodies. In certain embodiments, an anti-IGF-1R monoclonal antibody comprises a first sequence comprising in amino to carboxy order a VLCDR1 sequence, a VLCDR2 sequence and a VLCDR3 sequence of SF kappa light chain as indicated by dotted underlining in FIG. 5A, SEQ ID NO:202, antibody further comprising a second sequence comprising in amino to carboxy order a VHCDR1 sequence, a VHCDR2 sequence and a VHCDR3 sequence of SF heavy chain as indicated by the first three dotted underlined sequences respectively in FIG. 5A, SEQ ID NO:210, wherein the first sequence and the second sequence are non-overlapping. In certain embodiments, an anti-IGF-1R monoclonal antibody comprises in amino to carboxy order a VLCDR1 sequence, a VLCDR2 sequence and a VLCDR3 sequence of P4 kappa light chain as indicated by dotted underlining in FIG. 5A, SEQ ID NO:204, antibody further comprising in amino to carboxy order a VHCDR1 sequence, a VHCDR2 sequence and a VHCDR3 sequence of P4 heavy chain as indicated by the first three dotted underlined sequences respectively in FIG. 5A, SEQ ID NO:222. In certain embodiments, an anti-IGF-1R monoclonal antibody comprises in amino to carboxy order a VLCDR1 sequence, a VLCDR2 sequence and a VLCDR3 sequence of M78 kappa light chain as indicated by dotted underlining in FIG. 5A, SEQ ID NO:206, antibody further comprising in amino to carboxy order a VHCDR1 sequence, a VHCDR2 sequence and a VHCDR3 sequence of M78 heavy chain as indicated by the first three dotted underlined sequences respectively in FIG. 5A, SEQ ID NO:234. In certain embodiments, an anti-IGF-1R monoclonal antibody comprising in amino to carboxy order a VLCDR1 sequence, a VLCDR2 sequence and a VLCDR3 sequence of M57 kappa light chain as indicated by dotted underlining in FIG. 5A, SEQ ID NO:208, antibody further comprising in amino to carboxy order a VHCDR1 sequence, a VHCDR2 sequence and a VHCDR3 sequence of M57 heavy chain as indicated by the first three dotted underlined sequences respectively in FIG. 5A, SEQ ID NO:246.

In certain embodiments, an anti-IGF-1R antibody comprises a VH domain comprising a set of three VH CDRs comprising VHCDR1, VHCDR2, VHCDR3, and/or a VL domain comprising a set of three VL CDRs comprising VLCDR1, VLCDR2 and VLCDR3, CDRs comprising the sequences of SEQ ID NOs: 302, 303, 304, 305, 306, and 307, respectively, and each CDR further comprising an amino terminus and a carboxy terminus, wherein the CDRs of each set of CDRs are arranged in the antibody in a linear amino to carboxy order of CDR1, CDR2, and CDR3, wherein the CDRs comprise variable aas, which independently represent any aa set forth at the corresponding position in FIG. 1 (VH) or FIG. 2 (VL), and the antibody does not comprise the SF module. In certain embodiments, the VHCDR1, VHCDR2, VHCDR3, VLCDR1, VLCDR2 and VLCDR3 of an anti-IGF-1R antibody comprise the sequences of SEQ ID NOs: 302, 303, 304, 305, 306, and 308, respectively. In certain embodiments, the VHCDR1, VHCDR2 and VHCDR3 domains of an anti-IGF-1R antibody comprise the corresponding aa sequences of any one of SEQ ID NOs: 8-10 and 12-31, and the VLCDR1, VLCDR2 and VLCDR3 domains of the anti-IGF-1R antibody comprise the corresponding aa sequences of any one of SEQ ID NOs: 32-34 and 36-133. In certain embodiments, (a) the VHCDR1, VHCDR2, VHCDR3 of an anti-IGF-1R antibody comprise the aa sequence of the corresponding CDRs of SEQ ID NO:8 and the VLCDR1, VLCDR2 and VLCDR3 of the anti-IGF-1R antibody comprise the aa sequence of the corresponding CDRs of SEQ ID NO:32; or (b) the VHCDR1, VHCDR2, VHCDR3 of the anti-IGF-1R antibody comprise the aa sequence of the corresponding CDRs of SEQ ID NO:9 and the VLCDR1, VLCDR2 and VLCDR3 of the anti-IGF-1R antibody comprise the aa sequence of the corresponding CDRs of SEQ ID NO:33; or (c) the VHCDR1, VHCDR2, VHCDR3 of the anti-IGF-1R antibody comprise the aa sequence of the corresponding CDRs of SEQ ID NO:10 and the VLCDR1, VLCDR2 and VLCDR3 of the anti-IGF-1R antibody comprise the aa sequence of the corresponding CDRs of SEQ ID NO:34; or (d) the VHCDR1, VHCDR2, VHCDR3 of the anti-IGF-1R antibody comprise the aa sequence of the corresponding CDRs of SEQ ID NO:11 and the VLCDR1, VLCDR2 and VLCDR3 of the anti-IGF-1R antibody comprise the aa sequence of the corresponding CDRs of SEQ ID NO:35; or (e) the VHCDR1, VHCDR2, VHCDR3 of the anti-IGF-1R antibody comprise the aa sequence of the corresponding CDRs of SEQ ID NO:8 and the VLCDR1, VLCDR2 and VLCDR3 of the anti-IGF-1R antibody comprise the aa sequence of the corresponding CDRs of SEQ ID NO:33; or (f) the VHCDR1, VHCDR2, VHCDR3 of the anti-IGF-1R antibody comprise the aa sequence of the corresponding CDRs of SEQ ID NO:10 and the VLCDR1, VLCDR2 and VLCDR3 of the anti-IGF-1R antibody comprise the aa sequence of the corresponding CDRs of SEQ ID NO:32.

In certain embodiments, the VH domain of an anti-IGF-1R antibody comprises the aa sequence of SEQ ID NO:1, which sequence comprises variable aas, which independently represent any aa set forth at the corresponding position in FIG. 1; the VL domain of the anti-IGF-1R antibody comprises the aa sequence of SEQ ID NO:2 (or 3), which sequence comprises variable aas, which independently represent any aa set forth at the corresponding position in FIG. 2; or the VH domain of the anti-IGF-1R antibody comprises the aa sequence of SEQ ID NO:1 and the VL domain of the anti-IGF-1R antibody comprises the aa sequence of SEQ ID NO:2 or 3. In certain embodiments, the VH domain of an anti-IGF-1R antibody comprises an aa sequence selected from the group consisting of SEQ ID NOs: 8-10 and 12-31 and the VL domain comprises an aa sequence selected from the group consisting of SEQ ID NOs: 32-34 and 36-133.

In certain embodiments, (a) the VH domain of an anti-IGF-1R antibody comprises an aa sequence that is at least 90% identical to, or which differs in 1-30 aa aa substitutions, additions or deletions from, an aa sequence of any of SEQ ID NOs: 8-10 and 12-31, and/or (b) the VL domain of the anti-IGF-1R antibody comprises an aa sequence that is at least 90% identical to, or which differs in 1-30 aa aa substitutions, additions or deletions from, an aa sequence of an aa sequence of any of SEQ ID NOs: 32-34 and 36-133. In certain embodiments, (a) the VH domain of an anti-IGF-1R antibody comprises an aa sequence that is at least 95% identical to, or which differs in 1-10 aa aa substitutions, additions or deletions from, an aa sequence of any of SEQ ID NOs: 8-10 and 12-31, and/or (b) the VL domain comprises an aa sequence that is at least 95% identical to, or which differs in 1-10 aa aa substitutions, additions or deletions from, an aa sequence of an aa sequence of any of SEQ ID NOs: 32-34 and 36-133.

An anti-IGF-1R antibody may be an IgG1 antibody, e.g., an isolated and/or a monoclonal IgG1 antibody.

In certain embodiments, an anti-IGF-1R antibody is a protein comprising two pairs of polypeptide chains, each pair comprising a heavy chain and a light chain; wherein (a) each heavy chain comprises an aa sequence of SEQ ID NOs: 359, 360 or 361; and/or (b) each light chain comprises an aa sequence of SEQ ID NOs: 204, 206 or 208. In certain embodiments, an anti-IGF-1R antibody is a protein comprising two pairs of polypeptide chains, each pair comprising a heavy chain and a light chain; wherein (a) each heavy chain comprises an aa sequence that is at least 90% identical to, or which differs in 1-30 aa aa substitutions, additions or deletions from, an aa sequence of any of SEQ ID NOs:359, 360 or 361, and/or (b) each light chain comprises an aa sequence that is at least 90% identical to, or which differs in 1-30 aa aa substitutions, additions or deletions from, an aa sequence of an aa sequence of any of SEQ ID NOs: 204, 206 or 208. In certain embodiments, (a) each heavy chain of an anti-IGF-1R antibody comprises an aa sequence that is at least 95% identical to, or which differs in 1-10 aa aa substitutions, additions or deletions from, an aa sequence of any of SEQ ID NOs:359, 360 or 361, and/or (b) each light chain comprises an aa sequence that is at least 95% identical to, or which differs in 1-10 aa aa substitutions, additions or deletions from, an aa sequence of an aa sequence of any of SEQ ID NOs: 204, 206 or 208.

Exemplary antibodies include (a) an anti-IGF-R1 monoclonal IgG1 antibody P4 comprising two heavy chains, each comprising a heavy chain aa sequence of SEQ ID NO:359 and two light chains, each comprising a light chain aa sequence of SEQ ID NO:204; (b) an anti-IGF-R1 monoclonal IgG1 antibody M78 comprising two heavy chains, each comprising a heavy chain aa sequence of SEQ ID NO:360 and two light chains, each comprising a light chain aa sequence of SEQ ID NO:206; (c) an anti-IGF-R1 monoclonal IgG1 antibody M57 comprising two heavy chains, each comprising a heavy chain aa sequence of SEQ ID NO:361 and two light chains, each comprising a light chain aa sequence of SEQ ID NO:208; (d) an anti-IGF-R1 monoclonal IgG1 antibody M57/M78 comprising two heavy chains, each comprising a heavy chain aa sequence of SEQ ID NO:361 and two light chains, each comprising a light chain aa sequence of SEQ ID NO:206; and (e) an anti-IGF-R1 monoclonal IgG1 antibody P4/M57 comprising two heavy chains, each comprising a heavy chain aa sequence of SEQ ID NO:359 and two light chains, each comprising a light chain aa sequence of SEQ ID NO:208.

Anti-IGF-1R antibodies may comprise one or more additional binding sites, e.g., an anti-ErbB3 binding site.

Also provided are anti-ErbB3 monoclonal antibodies, e.g., monoclonal anti-ErbB3 antibodies. In certain embodiments, an anti-ErbB3 comprises in amino to carboxy order a VLCDR1 sequence, a VLCDR2 sequence and a VLCDR3 sequence of P1 lambda light chain as indicated by dotted underlining in FIG. 5B, SEQ ID NO:258, antibody further comprising in amino to carboxy order a VHCDR1 sequence, a VHCDR2 sequence and a VHCDR3 sequence of P1 heavy chain as indicated by the first three dotted underlined sequences respectively in FIG. 5B, SEQ ID NO:268. In certain embodiments, an anti-ErbB3 monoclonal antibody comprises in amino to carboxy order a VLCDR1 sequence, a VLCDR2 sequence and a VLCDR3 sequence of M27 lambda light chain as indicated by dotted underlining in FIG. 5B, SEQ ID NO:260, antibody further comprising in amino to carboxy order a VHCDR1 sequence, a VHCDR2 sequence and a VHCDR3 sequence of M27 heavy chain as indicated by the first three dotted underlined sequences respectively in FIG. 5B, SEQ ID NO:274. In certain embodiments, an anti-ErbB3 monoclonal antibody comprises in amino to carboxy order a VLCDR1 sequence, a VLCDR2 sequence and a VLCDR3 sequence of M7 lambda light chain as indicated by dotted underlining in FIG. 5B, SEQ ID NO:262, antibody further comprising in amino to carboxy order a VHCDR1 sequence, a VHCDR2 sequence and a VHCDR3 sequence of M7 heavy chain as indicated by the first three dotted underlined sequences respectively in FIG. 5B, SEQ ID NO:280. In certain embodiments, an anti-ErbB3 monoclonal antibody comprises in amino to carboxy order a VLCDR1 sequence, a VLCDR2 sequence and a VLCDR3 sequence of B72 lambda light chain as indicated by dotted underlining in FIG. 5B, SEQ ID NO:264, antibody further comprising in amino to carboxy order a VHCDR1 sequence, a VHCDR2 sequence and a VHCDR3 sequence of B72 heavy chain as indicated by the first three dotted underlined sequences respectively in FIG. 5B, SEQ ID NO:286. In certain embodiments, an anti-ErbB3 monoclonal antibody comprises in amino to carboxy order a VLCDR1 sequence, a VLCDR2 sequence and a VLCDR3 sequence of B60 lambda light chain as indicated by dotted underlining in FIG. 5B, SEQ ID NO:266, antibody further comprising in amino to carboxy order a VHCDR1 sequence, a VHCDR2 sequence and a VHCDR3 sequence of B60 heavy chain as indicated by the first three dotted underlined sequences respectively in FIG. 5B, SEQ ID NO:292.

In certain embodiments, an isolated anti-ErbB3 antibody binding specifically to human ErbB3 comprises a VH domain comprising a set of three VH CDRs comprising VHCDR1, VHCDR2, VHCDR3, and/or a VL domain comprising a set of three VL CDRs comprising VLCDR1, VLCDR2 and VLCDR3, CDRs comprising the sequences of SEQ ID NOs: 309, 310, 311, 312, 313, and 314, respectively, and each CDR further comprises an amino terminus and a carboxy terminus, wherein the CDRs of each set of CDRs are arranged in the antibody in a linear amino to carboxy order of CDR1, CDR2, and CDR3, wherein the CDRs comprise variable aas, which independently represent any aa set forth at the corresponding position in FIG. 3 (VH) or FIG. 4 (VL), and the antibody does not comprise the C8 module. In certain embodiments, the VHCDR1, VHCDR2, VHCDR3, VLCDR1, VLCDR2 and VLCDR3 of an anti-ErbB3 antibody comprise the sequences of SEQ ID NOs: 309, 310, 311, 312, 313, and 315, respectively. In certain embodiments, the VHCDR1, VHCDR2 and VHCDR3 domains of an anti-ErbB3 antibody comprise the corresponding aa sequences of any one of SEQ ID NOs: 134-142 and 144-165, and the VLCDR1, VLCDR2 and VLCDR3 domains of the antibody comprise the corresponding aa sequences of any one of SEQ ID NOs: 166-174 and 176-200.

In certain embodiments, the VHCDR1, VHCDR2, VHCDR3 of an anti-ErbB3 antibody comprise the aa sequence of the corresponding CDRs of SEQ ID NO:134 and the VLCDR1, VLCDR2 and VLCDR3 of the anti-ErbB3 antibody comprise the aa sequence of the corresponding CDRs of SEQ ID NO:166. In certain embodiments, the VHCDR1, VHCDR2, VHCDR3 of an anti-ErbB3 antibody comprise the aa sequence of the corresponding CDRs of SEQ ID NO:135 and the VLCDR1, VLCDR2 and VLCDR3 of the anti-ErbB3 antibody comprise the aa sequence of the corresponding CDRs of SEQ ID NO:167. In certain embodiments, the VHCDR1, VHCDR2, VHCDR3 of an anti-ErbB3 antibody comprise the aa sequence of the corresponding CDRs of SEQ ID NO:136 and the VLCDR1, VLCDR2 and VLCDR3 of the anti-ErbB3 antibody comprise the aa sequence of the corresponding CDRs of SEQ ID NO:168. In certain embodiments, the VHCDR1, VHCDR2, VHCDR3 of an anti-ErbB3 antibody comprise the aa sequence of the corresponding CDRs of SEQ ID NO:137 and the VLCDR1, VLCDR2 and VLCDR3 of the anti-ErbB3 antibody comprise the aa sequence of the corresponding CDRs of SEQ ID NO:169. In certain embodiments, the VHCDR1, VHCDR2, VHCDR3 of an anti-ErbB3 antibody comprise the aa sequence of the corresponding CDRs of SEQ ID NO:138 and the VLCDR1, VLCDR2 and VLCDR3 of the anti-ErbB3 antibody comprise the aa sequence of the corresponding CDRs of SEQ ID NO:170. In certain embodiments, the VHCDR1, VHCDR2, VHCDR3 of the anti-ErbB3 antibody comprise the aa sequence of the corresponding CDRs of SEQ ID NO:139 and the VLCDR1, VLCDR2 and VLCDR3 of the anti-ErbB3 antibody comprise the aa sequence of the corresponding CDRs of SEQ ID NO:171. In certain embodiments, the VHCDR1, VHCDR2, VHCDR3 of an anti-ErbB3 antibody comprise the aa sequence of the corresponding CDRs of SEQ ID NO:140 and the VLCDR1, VLCDR2 and VLCDR3 of the antibody comprise the aa sequence of the corresponding CDRs of SEQ ID NO:172. In certain embodiments, the VHCDR1, VHCDR2, VHCDR3 of an anti-ErbB3 antibody comprise the aa sequence of the corresponding CDRs of SEQ ID NO:141 and the VLCDR1, VLCDR2 and VLCDR3 of the anti-ErbB3 antibody comprise the aa sequence of the corresponding CDRs of SEQ ID NOs: 173. In certain embodiments, the VHCDR1, VHCDR2, VHCDR3 of an anti-ErbB3 antibody comprise the aa sequence of the corresponding CDRs of SEQ ID NO:142 and the VLCDR1, VLCDR2 and VLCDR3 of the anti-ErbB3 antibody comprise the aa sequence of the corresponding CDRs of SEQ ID NO:174. In certain embodiments, the VHCDR1, VHCDR2, VHCDR3 of an anti-ErbB3 antibody comprise the aa sequence of the corresponding CDRs of SEQ ID NO:136 and the VLCDR1, VLCDR2 and VLCDR3 of the anti-ErbB3 antibody comprise the aa sequence of the corresponding CDRs of SEQ ID NO:169.

In certain embodiments, the VH domain of an anti-ErbB3 antibody comprises the aa sequence of SEQ ID NO:4 (or 5), which sequence comprises variable aas, which independently represent any aa set forth at the corresponding position in FIG. 3 and/or the VL domain of the anti-ErbB3 antibody comprises the aa sequence of SEQ ID NO:6 (or 7), which sequence comprises variable aas, which independently represent any aa set forth at the corresponding position in FIG. 4. In certain embodiments, The VH domain of an anti-ErbB3 antibody comprises an aa sequence selected from the group consisting of SEQ ID NOs: 134-142 and 144-165 and/or the VL domain of the anti-ErbB3 antibody comprises an aa sequence selected from the group consisting of SEQ ID NOs: 166-174 and 176-200.

In certain embodiments, (a) the VH domain of an anti-ErbB3 antibody comprises an aa sequence that is at least 90% identical to, or which differs in 1-30 aa aa substitutions, additions or deletions from, an aa sequence of any of SEQ ID NOs: 134-142 and 144-165, and/or (b) the VL domain of the anti-ErbB3 antibody comprises an aa sequence that is at least 90% identical to, or which differs in 1-30 aa aa substitutions, additions or deletions from, an aa sequence of an aa sequence of any of SEQ ID NOs: 166-174 and 176-200. In certain embodiments, (a) the VH domain of an anti-ErbB3 antibody comprises an aa sequence that is at least 95% identical to, or which differs in 1-10 aa aa substitutions, additions or deletions from, an aa sequence of any of SEQ ID NOs: 134-142 and 144-165, and/or (b) the VL domain comprises an aa sequence that is at least 95% identical to, or which differs in 1-10 aa aa substitutions, additions or deletions from, an aa sequence of an aa sequence of any of SEQ ID NOs: 166-174 and 176-200.

An anti-ErbB3 antibody may be an IgG1 antibody, e.g., an isolated monoclonal IgG1 antibody.

In certain embodiments, an anti-ErbB3 antibody is a protein comprising two pairs of polypeptide chains, each pair comprising a heavy chain and a light chain; wherein (a) each heavy chain comprises an aa sequence of SEQ ID NOs: 362, 363, 364, 365 or 366; and/or (b) each light chain comprises an aa sequence of SEQ ID NOs: 258, 260, 262, 264 or 266. In certain embodiments, an anti-ErbB3 antibody is a protein comprising two pairs of polypeptide chains, each pair comprising a heavy chain and a light chain; wherein (a) each heavy chain comprises an aa sequence that is at least 90% identical to, or which differs in 1-30 aa aa substitutions, additions or deletions from, an aa sequence of any of SEQ ID NOs: 362, 363, 364, 365 or 366, and/or (b) each light chain comprises an aa sequence that is at least 90% identical to, or which differs in 1-30 aa aa substitutions, additions or deletions from, an aa sequence of an aa sequence of any of SEQ ID NOs: 258, 260, 262, 264 or 266. In certain embodiments, an anti-ErbB3 antibody is a protein comprising two pairs of polypeptide chains, each pair comprising a heavy chain and a light chain; wherein (a) each heavy chain comprises an aa sequence that is at least 95% identical to, or which differs in 1-10 aa aa substitutions, additions or deletions from, an aa sequence of any of SEQ ID NOs: 362, 363, 364, 365 or 366, and (b) each light chain comprises an aa sequence that is at least 95% identical to, or which differs in 1-10 aa aa substitutions, additions or deletions from, an aa sequence of an aa sequence of any of SEQ ID NOs: 258, 260, 262, 264 or 266.

An anti-ErbB3 antibody may comprise one or more other binding sites, e.g., an anti-IGF-1R binding site.

Exemplary anti-ErbB3 antibodies include: (a) an anti-ErbB3 monoclonal IgG1 antibody P1 comprising two heavy chains, each comprising a heavy chain aa sequence of SEQ ID NO:362 and two light chains, each comprising a light chain aa sequence of SEQ ID NO:258; (b) an anti-ErbB3 monoclonal IgG1 antibody M27 comprising two heavy chains, each comprising a heavy chain aa sequence of SEQ ID NO:363 and two light chains, each comprising a light chain aa sequence of SEQ ID NO:260; (c) an anti-ErbB3 monoclonal IgG1 antibody M7 comprising two heavy chains, each comprising a heavy chain aa sequence of SEQ ID NO:364 and two light chains, each comprising a light chain aa sequence of SEQ ID NO:262; (d) an anti-ErbB3 monoclonal IgG1 antibody B72 comprising two heavy chains, each comprising a heavy chain aa sequence of SEQ ID NO:365 and two light chains, each comprising a light chain aa sequence of SEQ ID NO:264; (e) an anti-ErbB3 monoclonal IgG1 antibody B60 comprising two heavy chains, each comprising a heavy chain aa sequence of SEQ ID NO:366 and two light chains, each comprising a light chain aa sequence of SEQ ID NO:266; and (f) an anti-ErbB3 monoclonal IgG1 antibody M27/M7 comprising two heavy chains, each comprising a heavy chain aa sequence of SEQ ID NO:363 and two light chains, each comprising a light chain aa sequence of SEQ ID NO:262.

Also provided are scFvs, which may be monoclonal scFvs. Exemplary scFvs include (a) anti-IGF-R1 scFv antibody P4 comprising an aa sequence of SEQ ID NO:367; (b) anti-IGF-R1 scFv antibody M57 comprising an aa sequence of SEQ ID NO:368; (c) anti-IGF-R1 scFv antibody M78 comprising an aa sequence of SEQ ID NO:369; (d) anti-ErbB3 scFv antibody C8 comprising an aa sequence of SEQ ID NO:370; (e) anti-ErbB3 scFv antibody P1 comprising an aa sequence of SEQ ID NO:371; (f) anti-ErbB3 scFv antibody M1.3 comprising an aa sequence of SEQ ID NO:372; (g) anti-ErbB3 scFv antibody M27 comprising an aa sequence of SEQ ID NO:373; (h) anti-ErbB3 scFv antibody P6 comprising an aa sequence of SEQ ID NO:374; and (i) anti-ErbB3 scFv antibody B69 comprising an aa sequence of SEQ ID NO:375.

Also provided are compositions comprising a PBA; an anti-IGF-1R antibody; or an anti-ErbB3 antibody and a pharmaceutically acceptable carrier. A composition comprising an anti-IGF-1R antibody may further comprise an anti-ErbB3 antibody. A composition comprising an anti-ErbB3 antibody may further comprise an anti-IGF-1R antibody.

Also provided are nucleic acid molecules, e.g., comprising at least one coding sequence, at least one coding sequence encoding an antibody or a chain thereof, as set forth herein. The nucleic acid molecule may comprise either or both of a promoter nucleotide sequence and an enhancer nucleotide sequence, which nucleotide sequence is operably linked to the at least one coding sequence and promotes or enhances the expression of the antibody. Also encompassed are vectors, e.g., vectors comprising one or more nucleic acid molecules provided herein, as well as host cells comprising one or more vectors provided herein. Also provided are methods for producing a PBA, an anti-IGF-1 antibody or an anti-ErbB3 antibody provided herein, comprising culturing a cell comprising one or more nucleic acids encoding the antibodies (e.g., a PBA) or chains thereof provided herein under conditions suitable for the expression of the PBA, anti-IGF-1 antibody or anti-ErbB3 antibody. Further provided are methods for treating a subject having cancer, said method comprising administering to the subject a therapeutically effective amount of one or more antibodies or PBAs or compositions provided herein.

Also provided here are anti-IGF-1R+anti-ErbB3 PBAs, wherein the PBA has a half-life of at least 45 hours in a Cynomolgus monkey, when the PBA is administered intravenously at doses equal to or higher than 5 mg/kg. In certain embodiments, a PBA has a half-life that is statistically significantly longer (e.g., by 50%, 2 fold or more) in an organism that is a mouse or a cynomolgus monkey than the half-life of another polyvalent bispecific ab in the same organism, binding to the same epitopes, wherein the orientation of antigen binding specificities is reversed between of the fab and of the scfv.

PBAs may suppress heregulin-induced pAKT signaling in a cell, e.g., a cancer cel, by at least 10%, 20%, 30%, 40%, 50%, 60%, 70%, 75%, 80%, 85%, 90%, 95%, 97%, 98%, 99% or 100%. PBAs may suppress IGF-1-induced pAKT signaling in a cell, e.g., a cancer cell, by at least 10%, 20%, 30%, 40%, 50%, 60%, 70%, 75%, 80%, 85%, 90%, 95%, 97%, 98%, 99% or 100%. PBAs may suppress insulin-induced pAKT signaling in a cell, e.g., a cancer cell, by at least 10%, 20%, 30%, 40%, 50%, 60%, 70%, 75%, 80%, 85%, 90%, 95%, 97%, 98%, 99% or 100%. PBAs may suppress the IGF-2-induced pAKT signaling in a cell, e.g., a cancer cell, by at least 10%, 20%, 30%, 40%, 50%, 60%, 70%, 75%, 80%, 85%, 90%, 95%%, 97%, 98%, 99% or 100%.

A PBA may inhibit mTOR activation (phosphorylation) in a tumor cell in vivo or in vitro to a greater extent than monospecific anti-IGF-1R Ab# A or than a monospecific anti-IGF-1R Ab that binds to the same epitope on IGF-1R as the PBA. PBAs may reduce mTOR protein levels in a tumor cell in vivo or in vitro to a greater extent than monospecific anti-IGF-1R Ab# A, or than a monospecific anti-IGF-1R Ab that binds to the same epitope on IGF-1R as the PBA. In certain embodiments, a PBA reduces mTOR activation or mTOR protein levels in a tumor cell in vivo or in vitro by a factor of at least 50%, or by 2, 3, 4 or 5 fold or greater than 5 fold relative to monospecific anti-IGF-1R Ab# A or relative to a monospecific anti-IGF-1R Ab that binds to the same epitope on IGF-1R as the PBA. In certain embodiments, a PBA is more effective at inhibiting tumor growth in a human xenograft model in nu/nu mice than is an equimolar amount of an anti-IGF-1R IgG. In some embodiments the xenograft models comprise human DU145, BxPC-3, SK-ES-1, or Caki-1 cell xenografts. In another embodiment, a polyvalent bispecific antibody is more effective at inhibiting tumor growth in a human xenograft model in nu/nu mice than is a combination of an equimolar amount of an anti-IGF-1R IgG combined with an equimolar amount of an anti-ErbB3 IgG.

BRIEF DESCRIPTION OF THE DRAWINGS

FIG. 1A-B: an alignment of exemplary IGF-1R VH sequences (SEQ ID NOs:8-31 and 384-385, numbered consecutively from top to bottom) and a consensus sequence (SEQ ID NO:1) derived therefrom. The CDRs are underlined and the SEQ ID NOs of the CDRs are provided above the CDRs as a number in square brackets (e.g., "[S.302]").

FIG. 2A-E: an alignment of exemplary IGF-1R VL sequences (SEQ ID NOs:32-133 and 386-387, numbered consecutively from top to bottom) and two consensus sequences (SEQ ID NOs:2 and 3) derived therefrom. SEQ ID NO:2 includes the VL domain of 16F, whereas SEQ ID NO:3 does not. The CDRs are underlined and the SEQ ID NOs of the CDRs are provided above the CDRs as a number in square brackets.

Figure 3A:
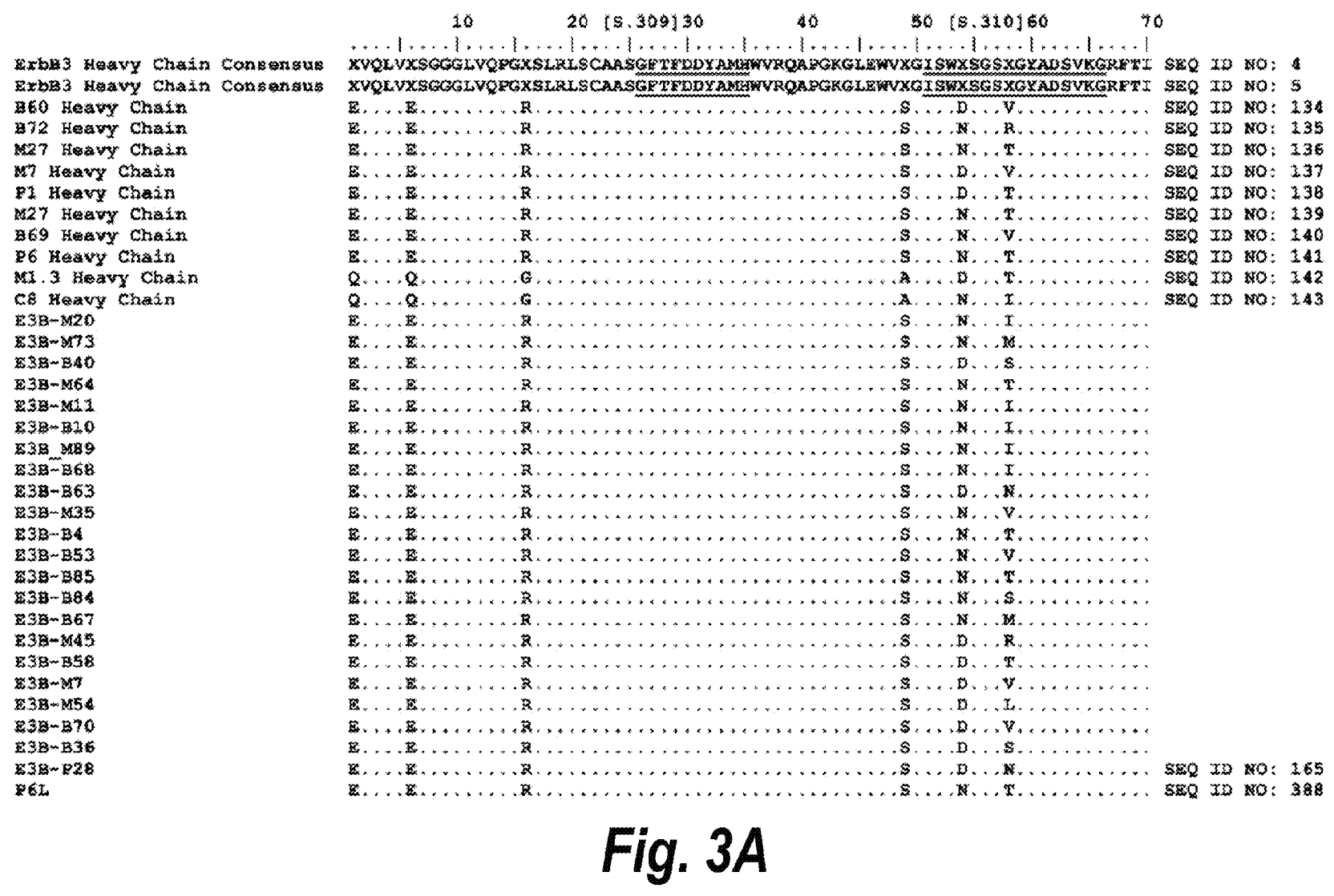
Figure 8:
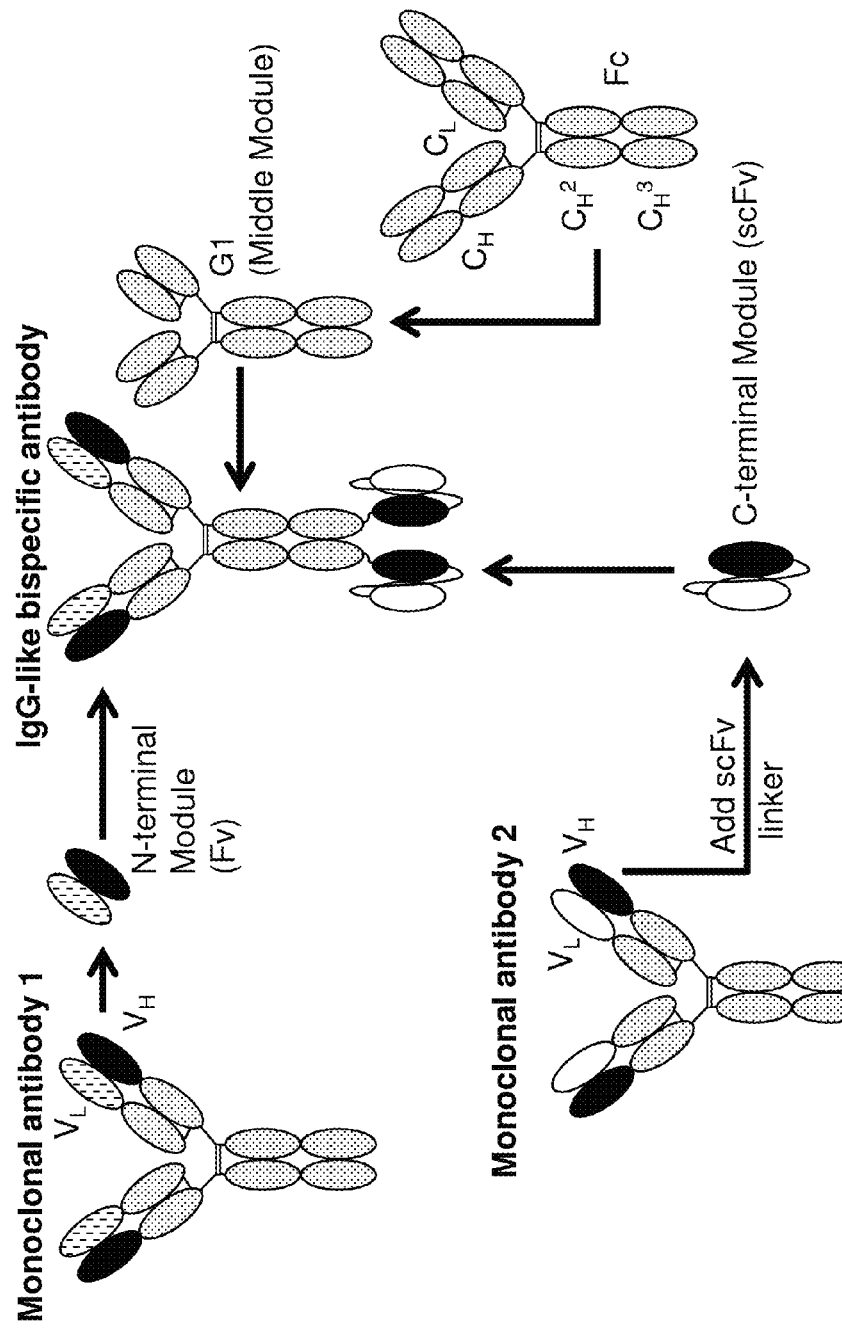

FIG. 3A-B: an alignment of exemplary ErbB3 VH sequences (SEQ ID NOs:134-165 and 388, numbered consecutively from top to bottom) and two consensus sequences (SEQ ID NOs:4 and 5) derived therefrom. SEQ ID NO:4 includes the VH domain of 16F, whereas SEQ ID NO:5 does not. The CDRs are underlined and the SEQ ID NOs of the CDRs are provided above the CDRs as a number in square brackets.

Figure 4A:
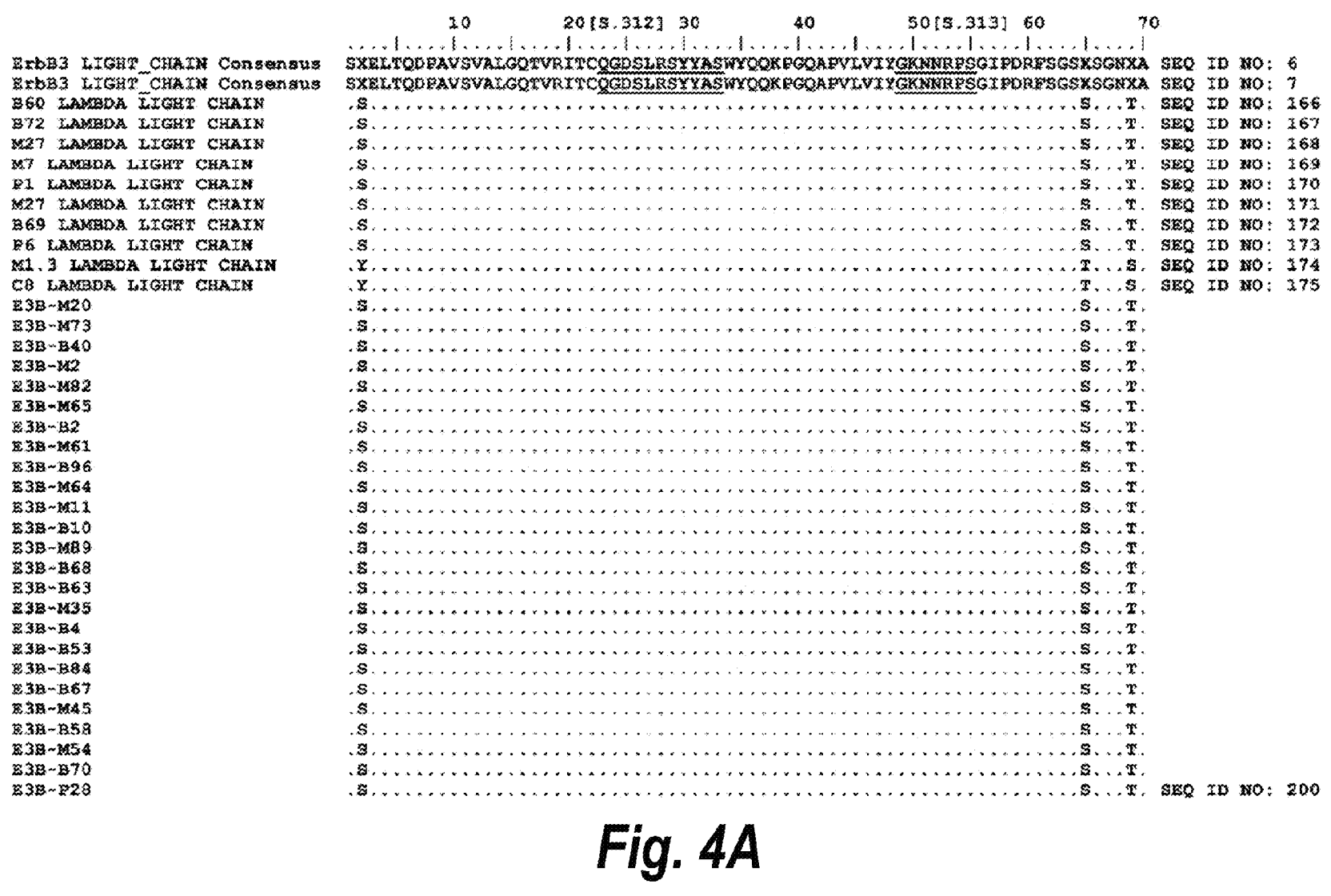
Figure 4B:
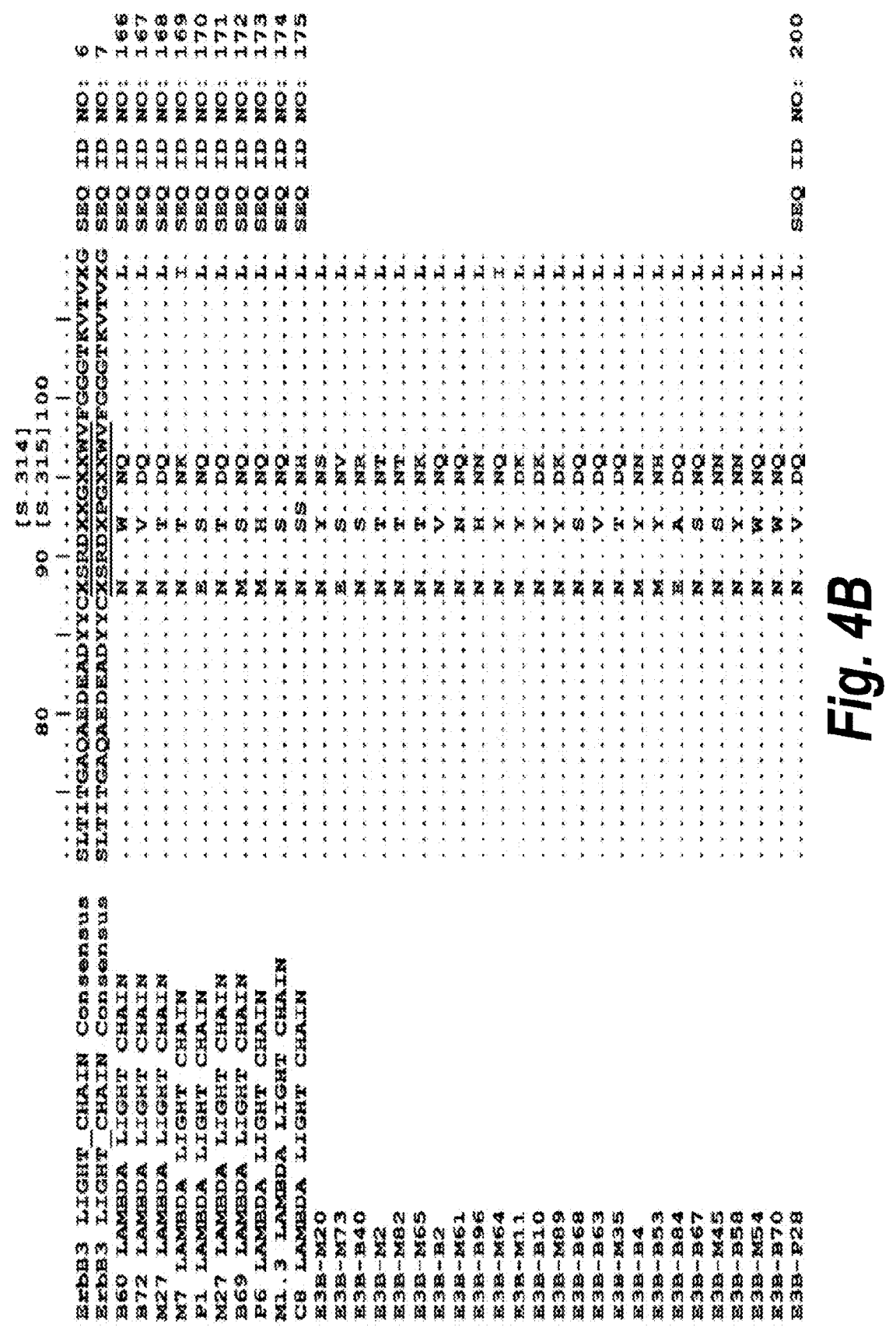

FIG. 4A-B: an alignment of exemplary ErbB3 VL sequences (SEQ ID NOs:166-200, numbered consecutively from top to bottom) and two consensus sequences (SEQ ID NOs:6 and 7) derived therefrom. SEQ ID NO:6 includes the VL domain of 16F, whereas SEQ ID NO:7 does not. The CDRs are underlined and the SEQ ID NOs of the CDRs are provided above the CDRs as a number in parenthesis.

FIG. 5: Aa sequences of the light and heavy chains of exemplary anti-IGF-1R-IgG1-anti-ErbB3 (FIG. 5 A) and anti-ErbB3-IgG1-anti-IGF-1R (FIG. 5B) polyvalent bispecific antibodies.

FIG. 5A shows the aa sequences of the following anti-IGF-1R-IgG1-anti-ErbB3 hybrid heavy chains: SF-G1-C8 (i.e., 16F—SEQ ID NO:210); SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256).

FIG. 5B shows the aa sequences of the following anti-ErbB3-IgG1-anti-IGF-1R hybrid heavy chains: P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); B60-G1-M78 (SEQ ID NO:296); B60-G2-M78 (SEQ ID NO:355) and M7-G2-M78 (SEQ ID NO:357).

Each of these hybrid heavy chains of FIGS. 5A and 5B comprises three named modules and each is named according to its modular composition (see FIG. 8), with, on the left, the name of a first, amino-terminal module, in the middle, the name of the second, middle module (always G1 or G2, as indicated, in the polyvalent bispecific antibodies whose sequences are provided in FIGS. 5A and 5B) and on the right, the name of the third, carboxy-terminal module. Each first, amino-terminal module comprises a heavy chain VR comprising from left to right a VHCDR1, a VHCDR2 and a VHCDR3, each indicated by dotted underlining. Each second, middle module is named G1 or G2 and comprises an IgG1 CR, and does not form an antigen binding site in a polyvalent bispecific antibody. The hinge, CH2 and CH3 portions of the G1 or G2 module sequence is single underlined. The CH1 portion starts at ASTK (SEQ ID NO:392). A Gly-Ser linker sequence linking the G1 module with the third module is double underlined. Each third, carboxy-terminal module appears to the right of this Gly-Ser linker sequence and comprises an scFv that comprises a heavy chain VR comprising from left to right a VHCDR1, a VHCDR2 and a VHCDR3 (each dotted underlined), a Gly-Ser scFv linker (double wavy underlined), and a light chain VR comprising a VLCDR1, a VLCDR2 and a VLCDR3 (each dotted underlined).

The binding specificity of each amino or carboxy-terminal heavy chain module is the same as the correspondingly named light chain of FIG. 5A or 5B.

FIG. 5A shows aa ("aa") sequences of the following mature anti-IGF-R1 kappa light chains: SF (SEQ ID NO:202), P4 (SEQ ID NO:204), M78 (SEQ ID NO:206), and M57 (SEQ ID NO:208).

FIG. 5B shows aa sequences of the following mature anti-ErbB3 lambda light chains: P1 (SEQ ID NO:258), M27 (SEQ ID NO:260), M7 (SEQ ID NO:262), B72 (SEQ ID NO:264), and B60 (SEQ ID NO:266).

Each light chain of FIGS. 5A and 5B comprises, from left to right, a VLCDR1, a VLCDR2 and a VLCDR3 (each dotted underlined). The CL domain starts at "RTVAA" (SEQ ID NO:393) in the anti-IGF-1R VL domain and at "QPKAA" (SEQ ID NO:394) in the anti-ErbB3 VL domain.

To form an entire polyvalent bispecific antibody comprising the heavy and light chains of FIGS. 5A and 5B, each heavy chain is co-expressed with a light chain which shares the name of the amino-terminal module of the heavy chain. Each of the resultant polyvalent bispecific antibodies takes the form of an IgG antibody (which comprises, as do native IgG antibodies, two essentially identical antigen binding sites) with an scFv appended to the carboxy terminus of each of the two heavy chains of the IgG.

FIG. 6: Aa sequences of the heavy chains of exemplary 6A) anti-IGF-1R IgG1 antibodies and 6B) anti-ErbB3 IgG1 antibodies; and aa sequences of 6C) anti-IGF-1R scFvs, and 6D) anti-ErbB3 scFvs.

FIG. 7: Aa sequences of 7A) the heavy chains and 7B) the light chains, of SF-G1-C8 (16F), each with a leader sequence that is absent in the mature antibody. The heavy chain aa sequence (SEQ ID NO:300) is that of SF-G1-C8 (SEQ ID NO:210) with an added N-terminal leader sequence. The light chain aa sequence (SEQ ID NO:298) is that of SF kappa light chain (SEQ ID NO:202) with an added N-terminal leader sequence. The leader sequences are in boldface and underlined; the dotted underlined sequences are CDRs as indicated above each; the linkers (hinge, connecting linker and scFv linker) are indicated above their boldfaced sequences, and the individual CH3 aa residues E356 and M358 are in bold (these are aas that can be substituted as follows E356D and M358L). The identities of the CH1, CH2, CH3, VH and VL domains in FIG. 7A and the CL domain in FIG. 7B are indicated above each domain, with the start point of each indicated by a right-angled arrow.

FIG. 8: Schematic view showing the derivation of modules of an Ig-like tetravalent bispecific antibody. The antibodies from which the binding domains ("N-terminal module" and "C-terminal module") are derived are labeled monoclonal antibody 1 and monoclonal antibody 2. The diagrams and modules are conceptual in nature; the actual DNA fragments that are joined together to prepare such a bispecific antibody may not coincide with the limits of the modules, but the end result is essentially as shown. Furthermore, monoclonal antibody 1 and monoclonal antibody 2 may not be in IgG format as shown—for example, either or both may be an scFv. If an scFv is used as the source of an N-terminal module, it is converted from scFv format to Fv format by removal of the DNA sequence encoding the scFv linker to yield VH and VL regions that are comprised by heavy and light polypeptide chains respectively.

FIG. 9: Simulation of the ErbB network predicts design of an optimal ErbB3 therapeutic. 9A) Complexity of the ErbB network depicted graphically: Each of ligand binding, receptor dimerization, receptor trafficking and intracellular signaling were captured in a mass-action based kinetic model. 9B) Simulated perturbation of each protein in the ErbB network was used to identify the sensitivity of the downstream signal, phospho-Akt, towards each protein under either heregulin or betacellulin stimulation. Dose responsiveness of Akt to an anti-ErbB3 antibody under either heregulin (9C) or betacellulin (9D) stimulation was examined for a variety of affinity binding constants through variation of the dissociation rate. The order of Kds listed for each graph from top to bottom corresponds to the order of curves in each graph from left to right.

FIG. 10: Ability of a bispecific antibody to co-inhibit two pathways is predicted to be dependent on relative receptor levels. The effect of a computationally simulated bispecific antibody on the active level of A) IGF-1R, B) ErbB3 and C) a common downstream signaling pathway element, Akt (the Akt kinase), was computationally simulated for cells expressing three different molar ratios of each receptor to the other. The three curves in each graph can be identified by the relative positions at which each of their right-hand ends intersects the boarder of the graph. Leftmost x-axis/bottommost y-axis intersecting curve=simulation of 10 times more of IGF-1R than ErbB3, middle intersecting curve=simulation of equal levels of IGF-1R and ErbB3, rightmost x-axis/topmost y-axis intersecting curve=simulation of 10 times more ErbB3 than IGF-1R. Due to the lower affinity of the bispecific towards IGF-1R, potency of IGF-1R inhibition decreases when the ErbB3 levels decrease, indicating the effect of avidity. Failure to potently inhibit IGF-1R leads to a decreased ability to inhibit pAkt (right). The ability to inhibit ErbB3 is unaffected by the level of IGF-1R due the stronger affinity of the bispecific towards ErbB3.

FIG. 11: Concurrent optimization of scFv affinity and stability by covalent yeast display. 11A) Affinity of post-thermal-challenge-isolated yeast-displayed scFv modules to soluble GFR2(ErbB3)-Fc measured by fluorescence-activated cell sorting. 11B) Thermal challenge assay on optimized scFv modules covalently attached to yeast surface confirms their higher thermal stability. The residual binding activity to ErbB3-Fc remaining after heat stress for 5 minutes at 65° C. was measured by fluorescence-activated cell sorting. MFI=mean fluorescence intensity.

Figure 12A:
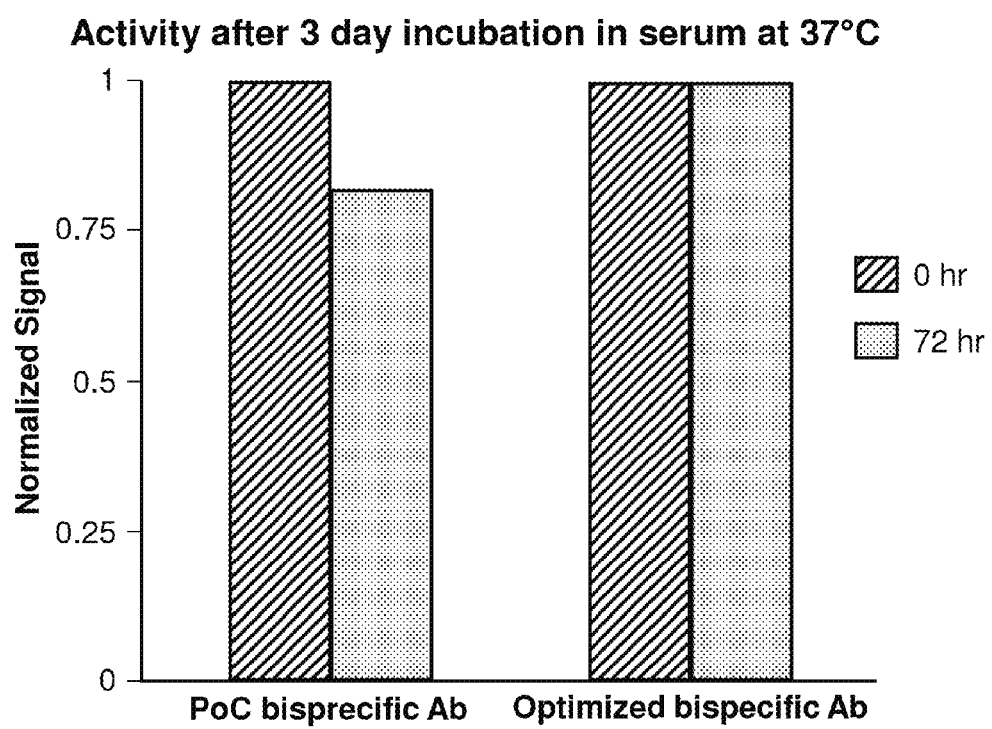
Figure 12B:
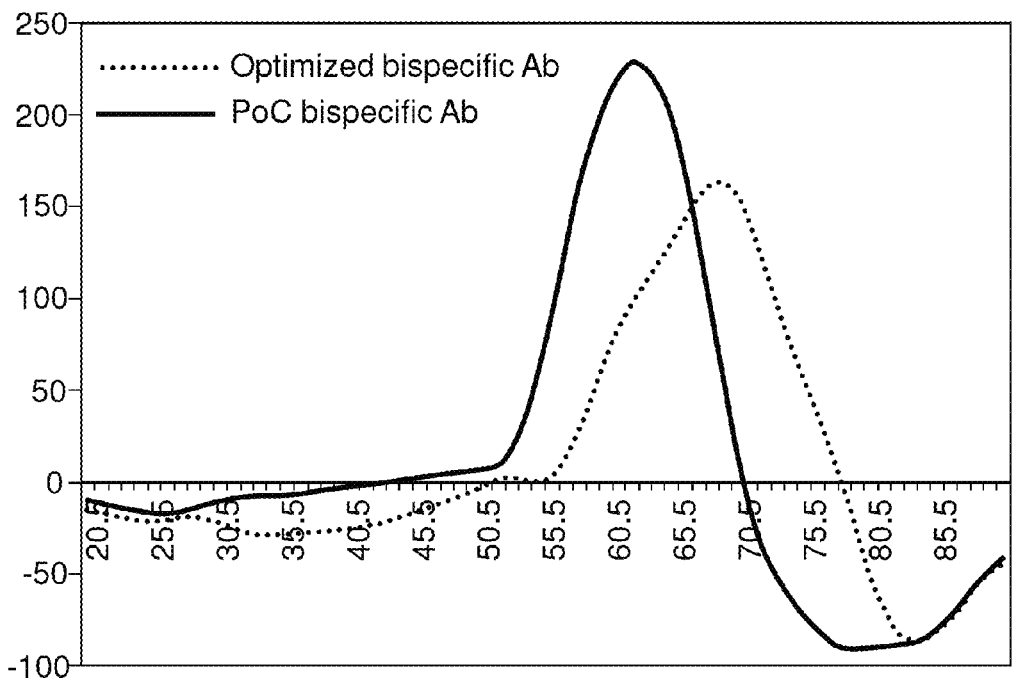

FIG. 12: Differential scanning fluorescence can be used to estimate serum stability. 12A) Microscopic stability measurement by differential scanning fluorimetry. 12B) Macroscopic stability measured by percent of binding activity before (100%) and after 3 day incubation in mouse serum at 37° C. The proof-of-concept bispecific protein exhibits inferior stability compared to a stabilized analog in both microscopic (A) and macroscopic (B) properties.

Figure 13:
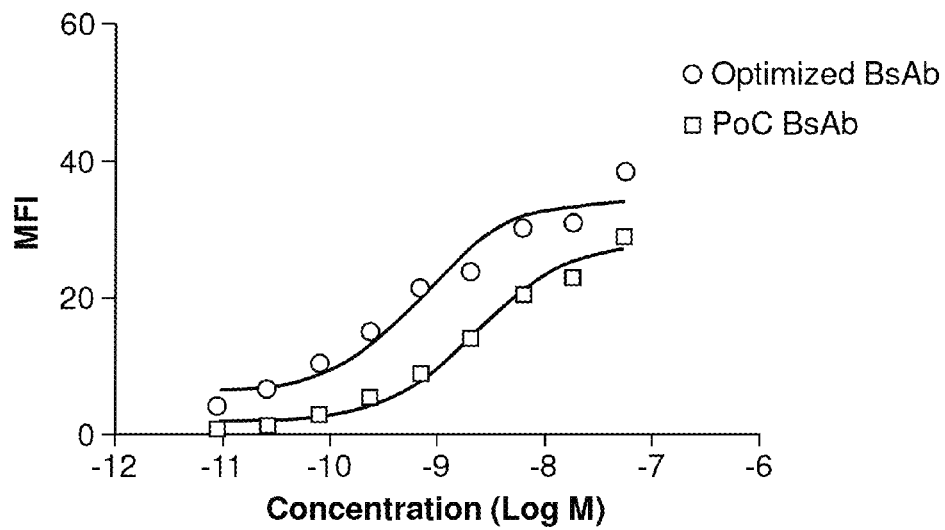

FIG. 13: Optimized bispecific antibody displays stronger cellular binding compared to proof-of-concept bispecific antibody. Binding to BxPC-3 cells, which express both IGF-1R and ErbB3, was measured by fluorescence-activated cell sorting.

Figure 14A:
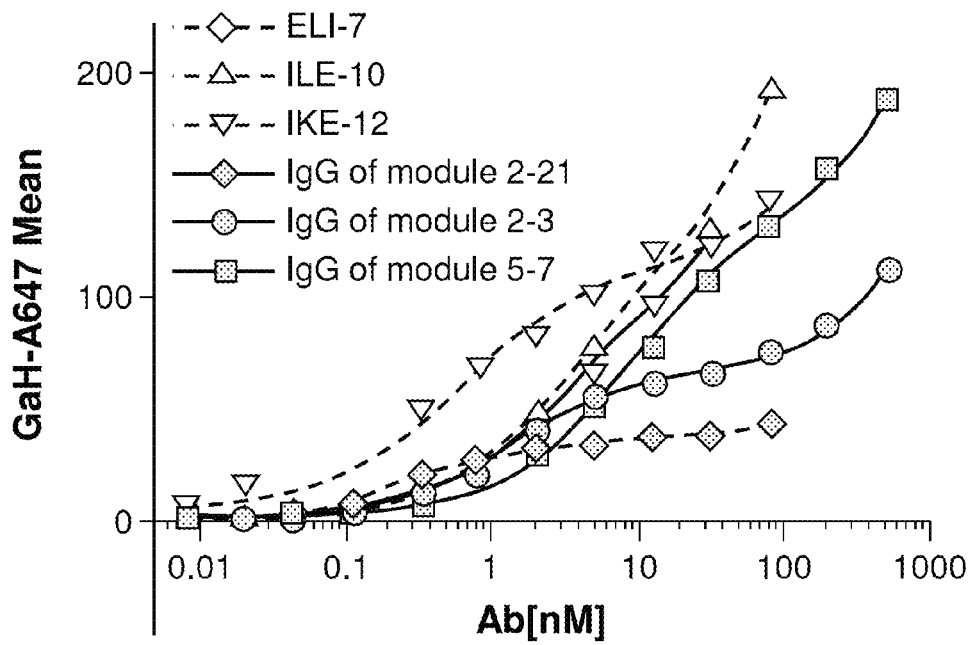
Figure 14B:
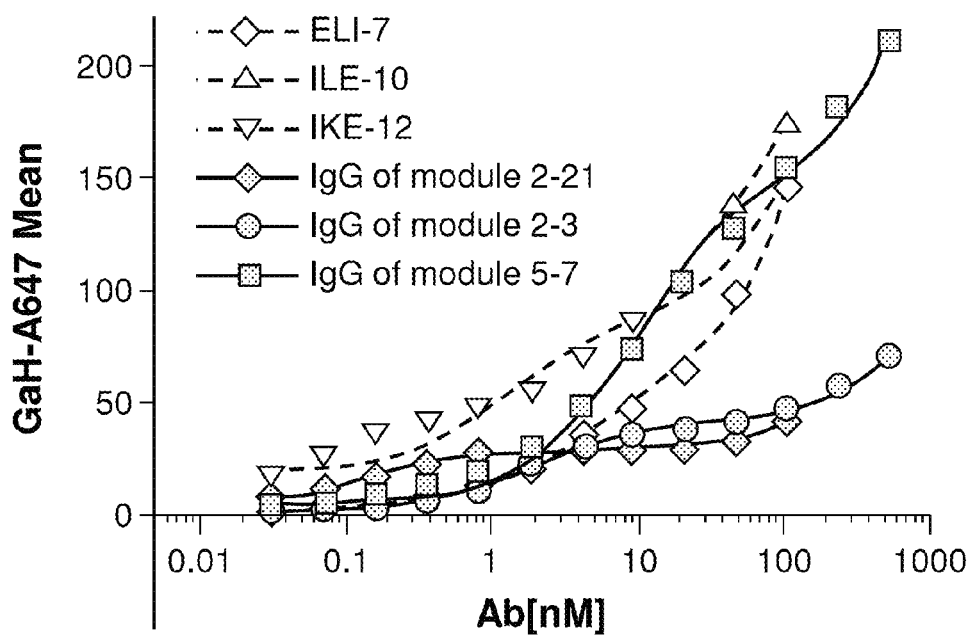

FIG. 14: Binding to ADRr and MCF7 cells. 14A) Binding to ADRr cells. As used in this figure and in FIGS. 14B, 18, 19, 20A and 20B, below, "IgG of module 2-21" refers to an anti-ErbB3 antibody having the same anti-ErbB3 VRs as those in ILE-12. "IgG of module 2-3" refers an anti-ErbB3 antibody having the same anti-ErbB3 VRs as those in ELI-7 and ILE-10. "IgG of module 5-7" refers to an anti-IGF-1R antibody having the same anti-IGF-1R VRs as those in ELI-7, ILE-10 and ILE-12. 14B) Binding to MC7 cells.

Figure 15:
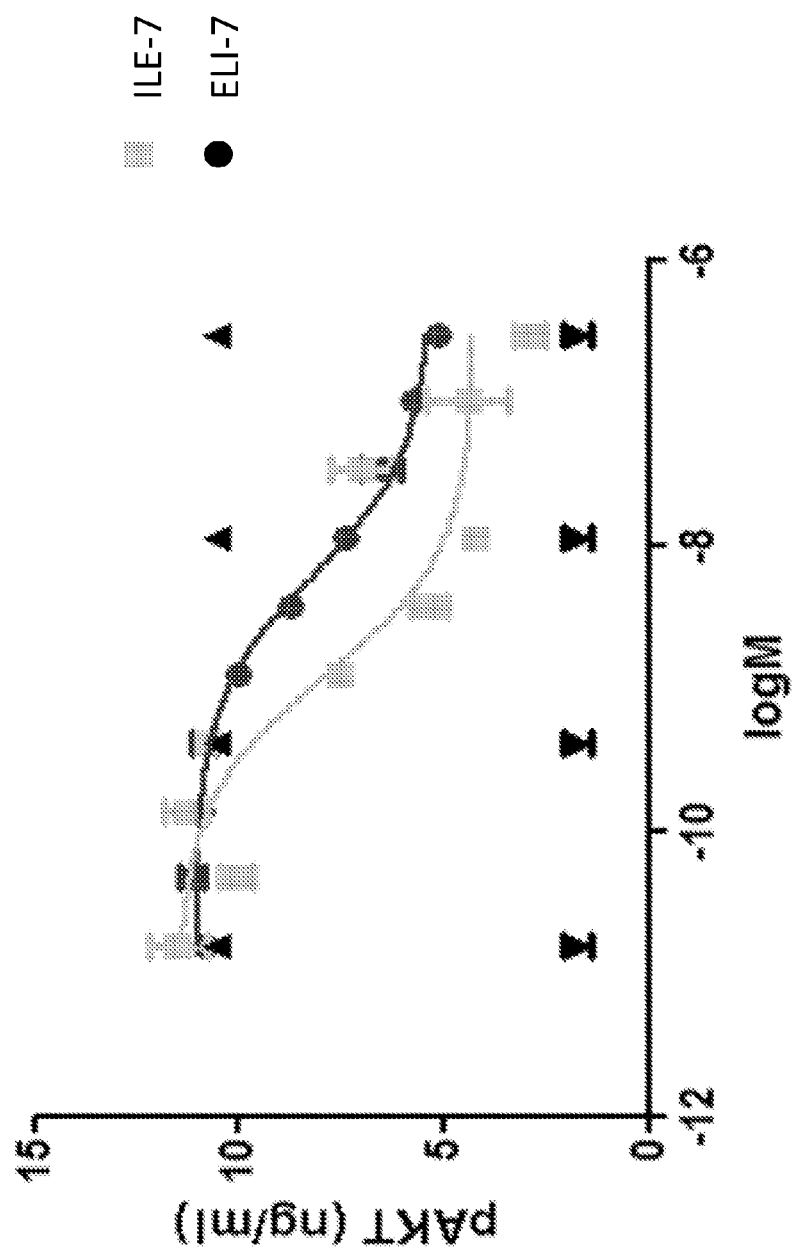

FIG. 15: pAKT inhibition by ILE-7 and ELI-7.

Figure 16:
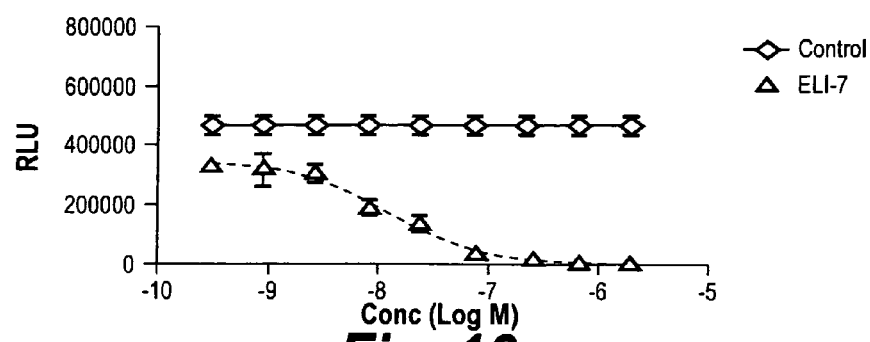

FIG. 16: Effect of ELI-7 on growth of DU145 cells (measured by CTG assay). RLU=relative luminescence units.

Figure 17:
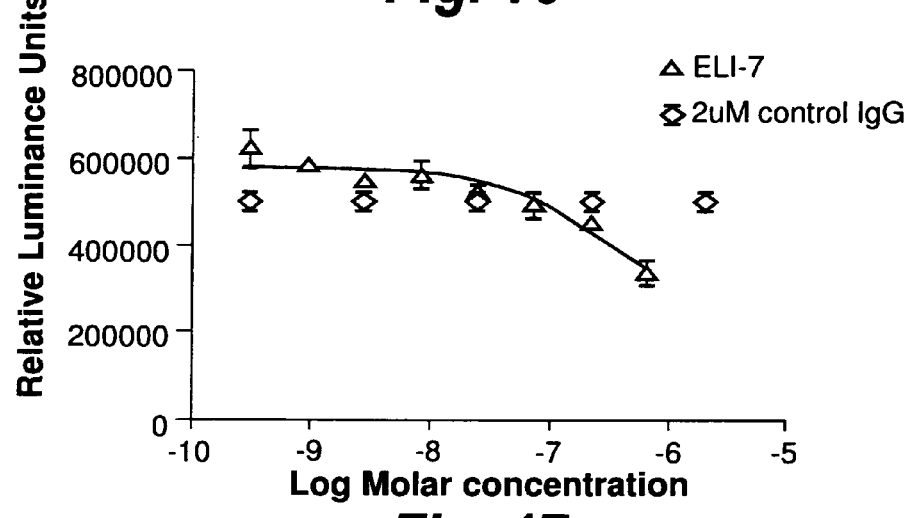

FIG. 17: Inhibition of BxPC-3 cell growth by ELI-7 measured by CTG assay.

Figure 18:
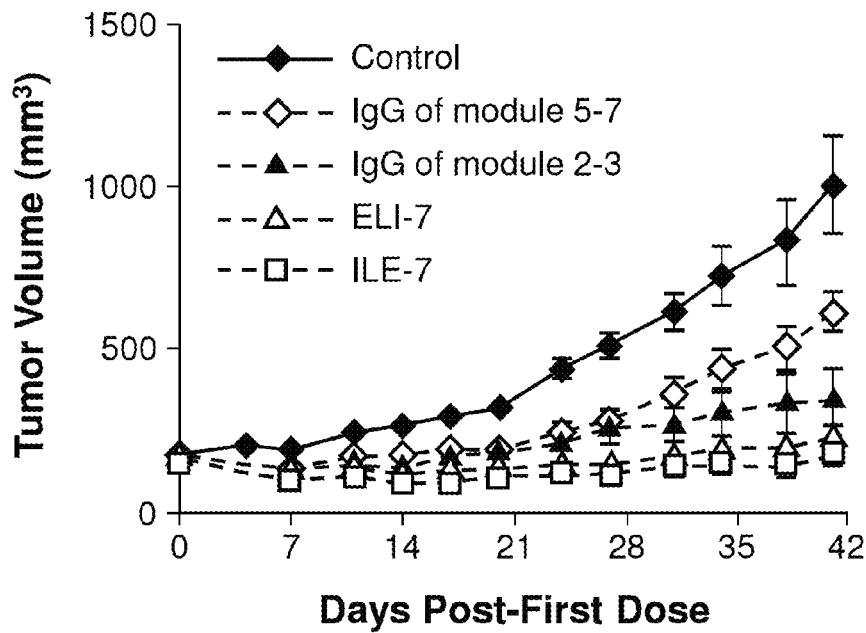

FIG. 18: Xenograft tumor growth curves. A description of the IgG antibodies is provided in the figure legend of FIG. 14A.

Figure 19:
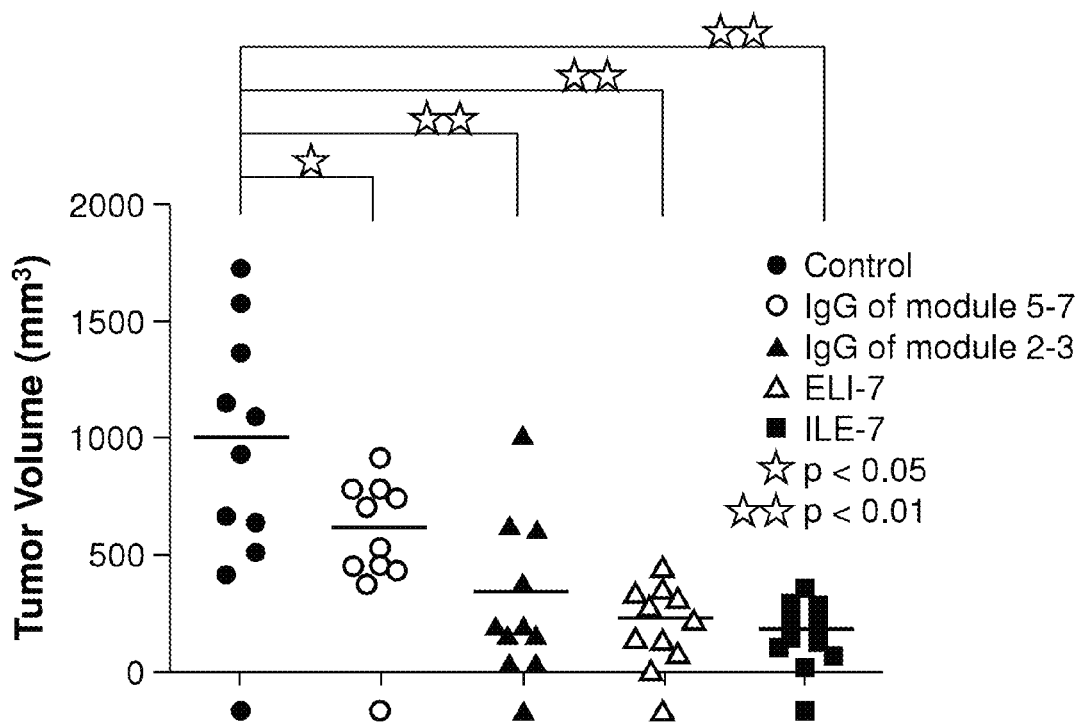
Figure 20A:
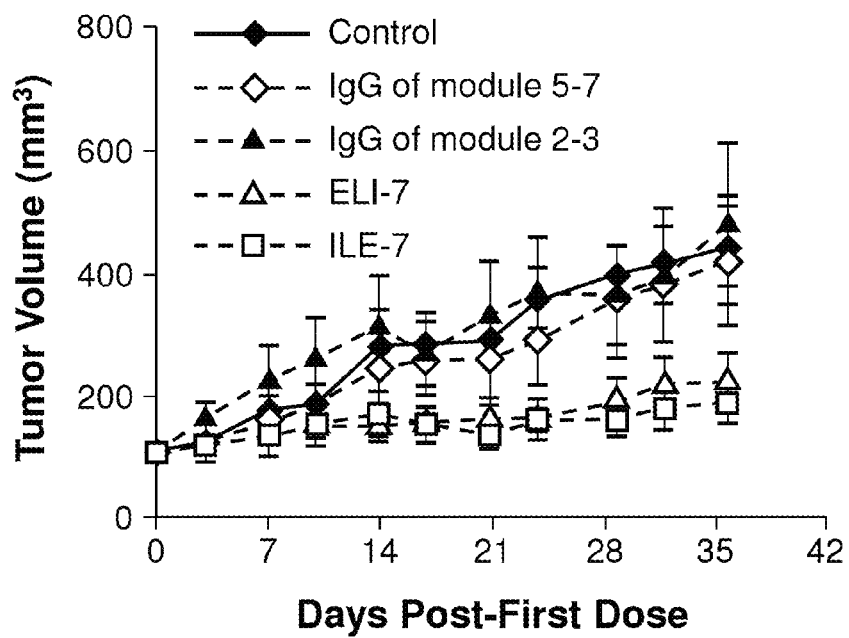
Figure 20B:
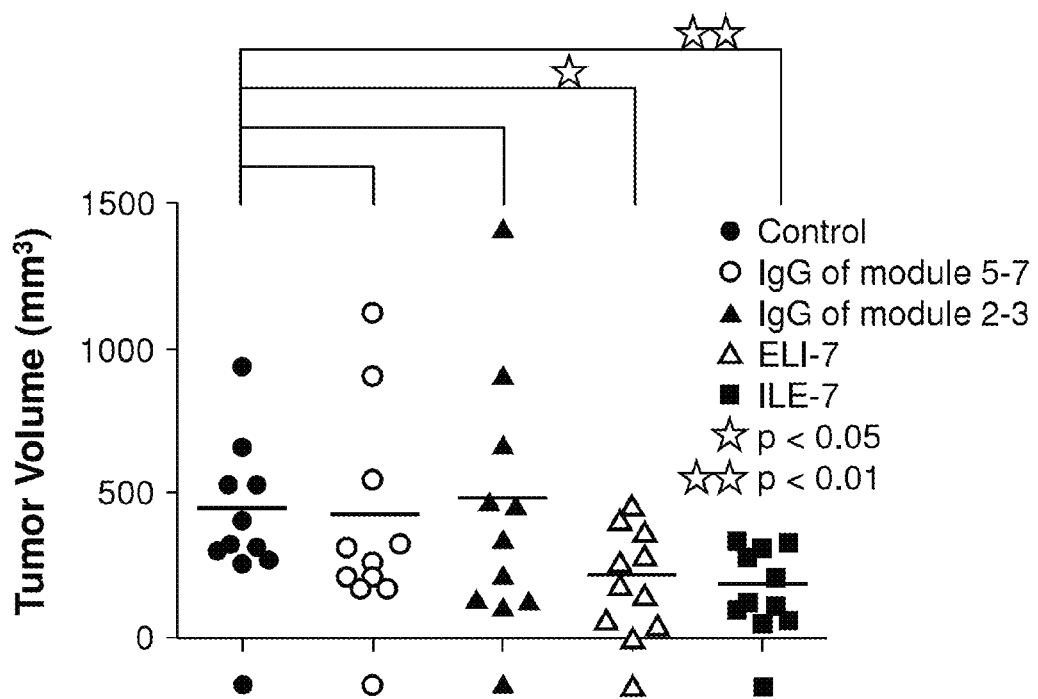

FIG. 19: BxPC-3 final xenograft tumor volumes on Day 41.

FIG. 20: Xenograft tumor growth rates and sizes. 20A) DU145 Tumor Growth Curves. 20B) DU145 Tumor Volumes on Day 36.

Figure 21:
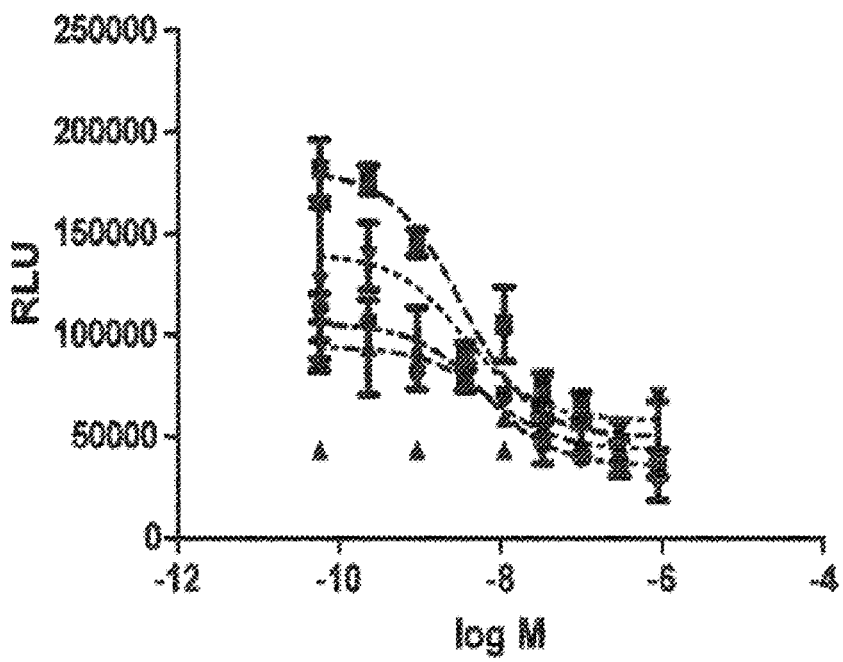

FIG. 21: Polyvalent bispecific antibodies inhibit signaling across a broad range of ErbB3 and IGF-1R receptor levels. ELI-7 displays inhibition of pAkt across BxPC-3 cell lines modified to contain a broad range of IGF1R and ErbB3 receptor levels. "BxPC-3-Control" refers to BxPC-3 cells with unchanged IGF-1R and ErbB3 levels. "BxPC-3-IGF1R-Mod1" refers to BxPC-3 cells in which the IGF-1R level is reduced by 37%. "BxPC-3-ErbB3-Mod1" refers to BxPC-3 cells in which the ErbB3 level is reduced by 48%. "BxPC-3-ErbB3-Mod2" refers to BxPC-3 cells in which the ErbB3 level is reduced by 88%.

Figure 22:
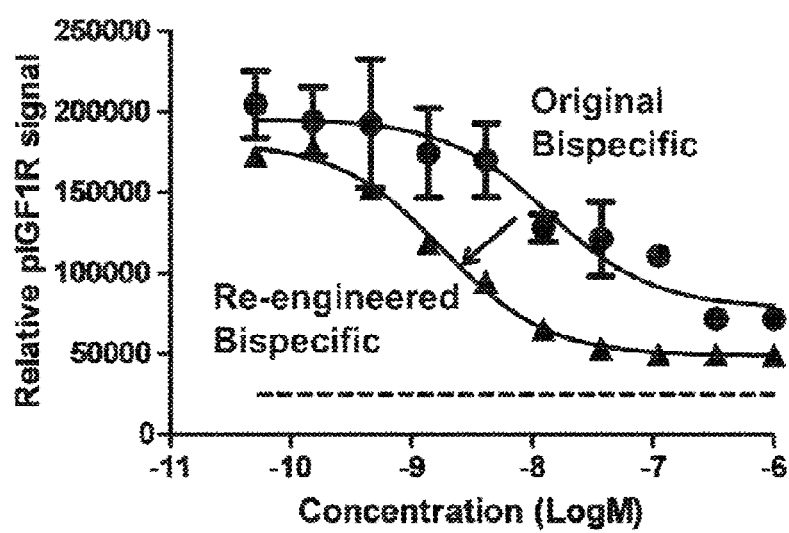
Figure 23A:
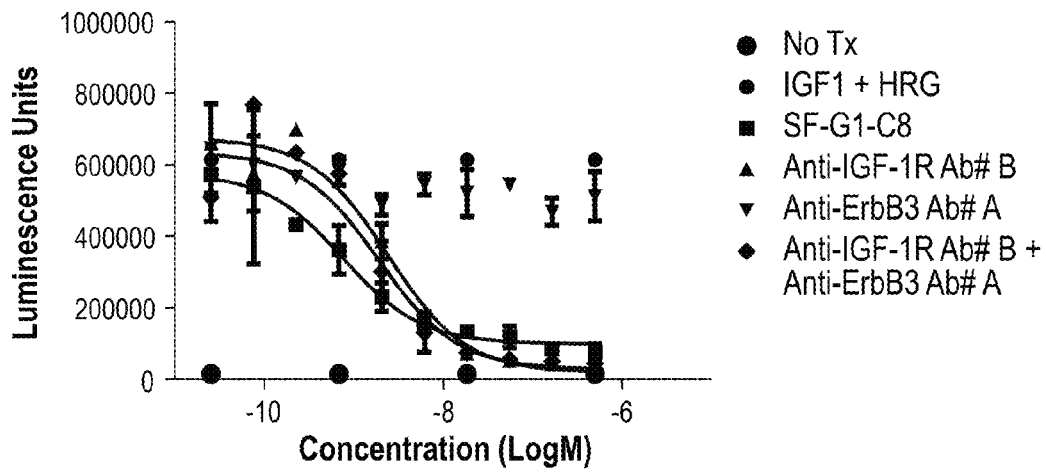
Figure 23B:
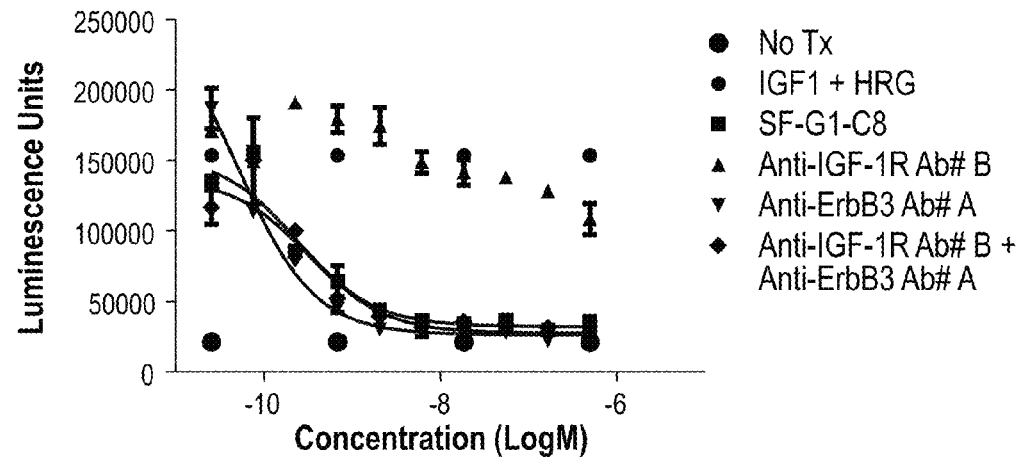
Figure 23C:
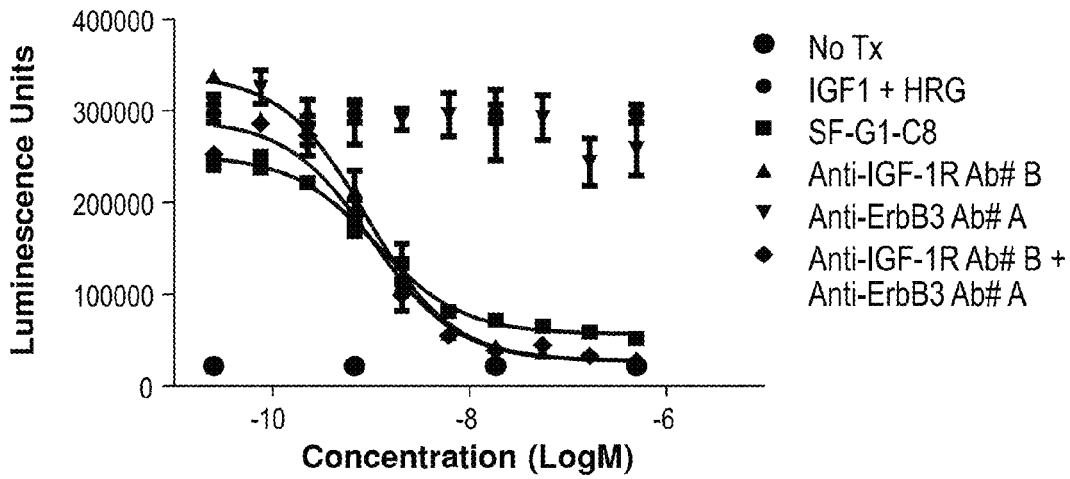
Figure 23D:
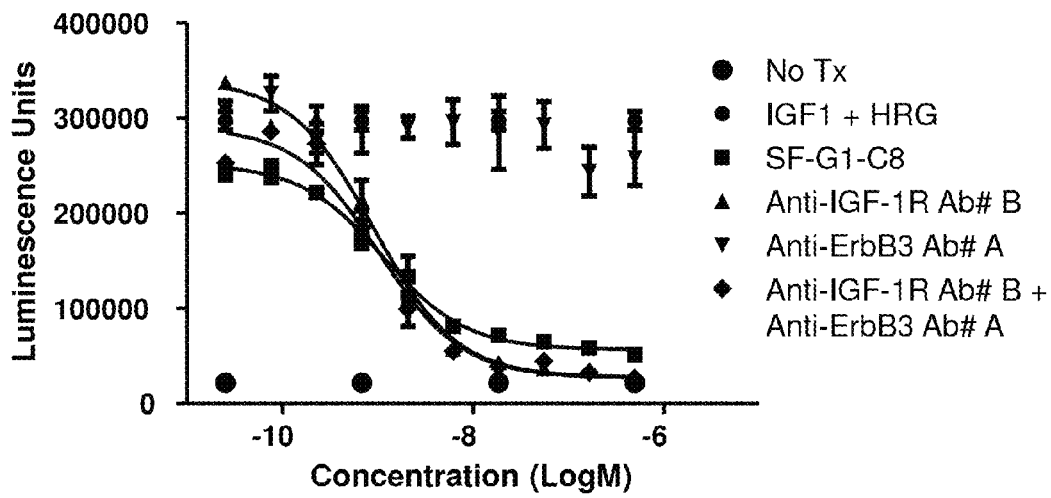
Figure 23E:
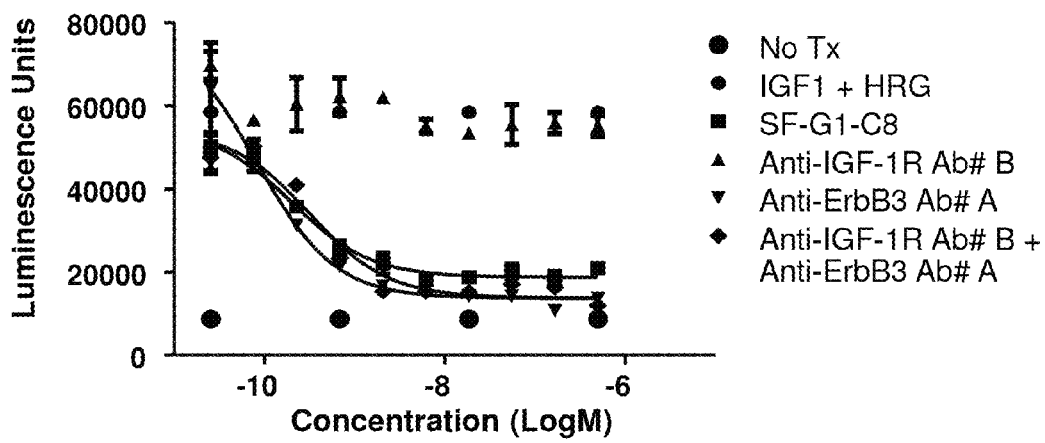
Figure 23F:
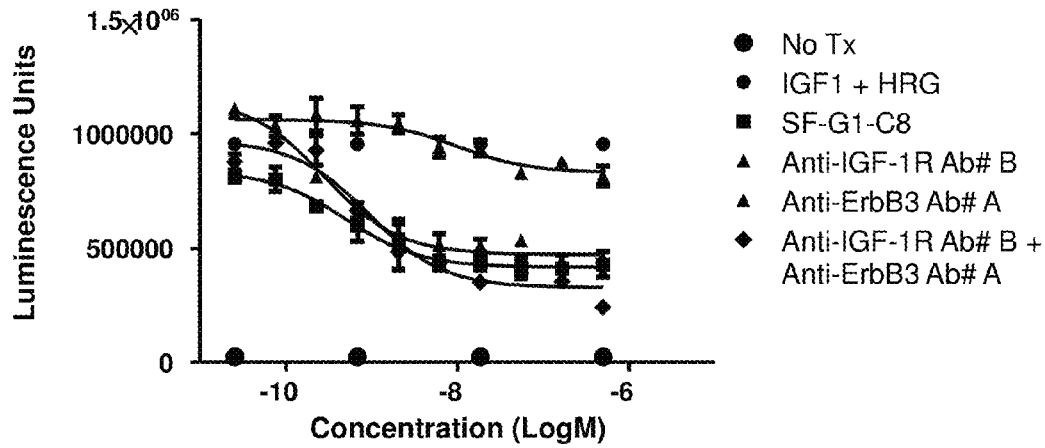
Figure 24A:
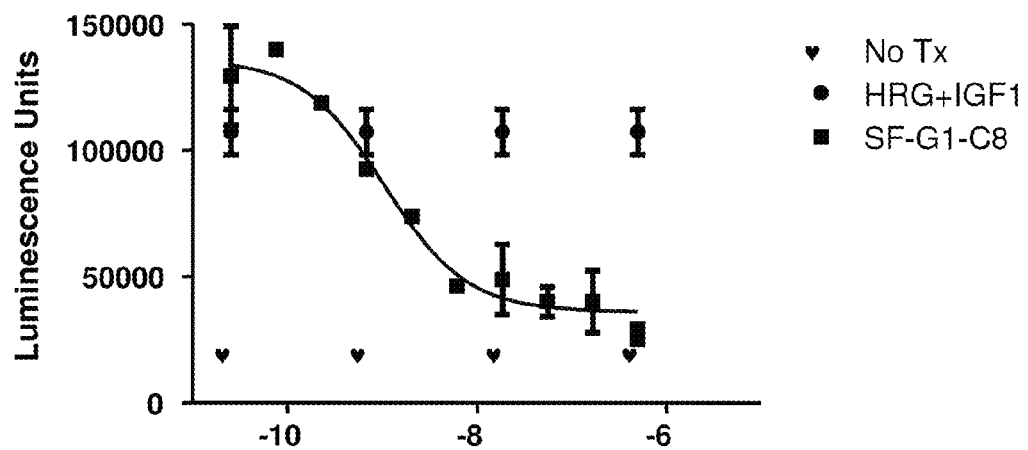
Figure 24B:
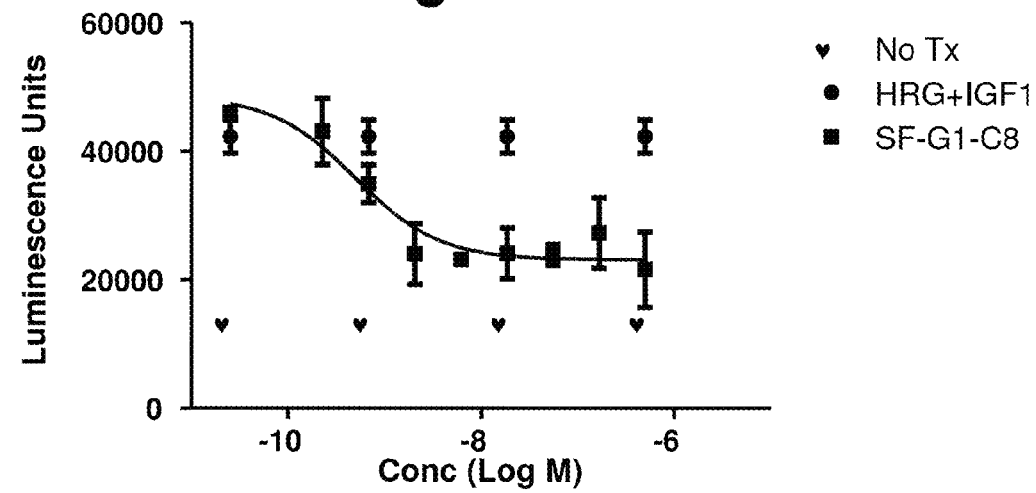
Figure 24C:
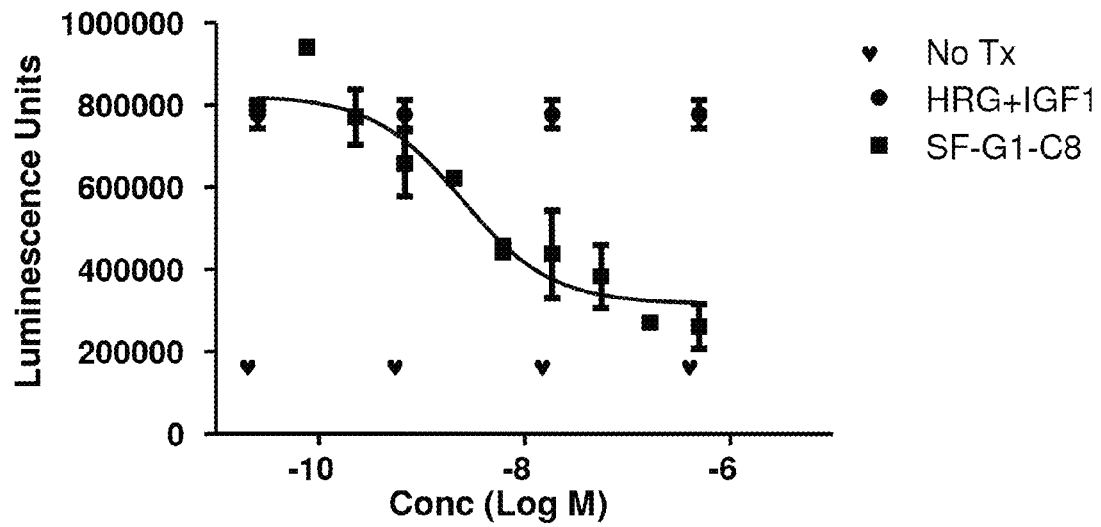
Figure 24D:
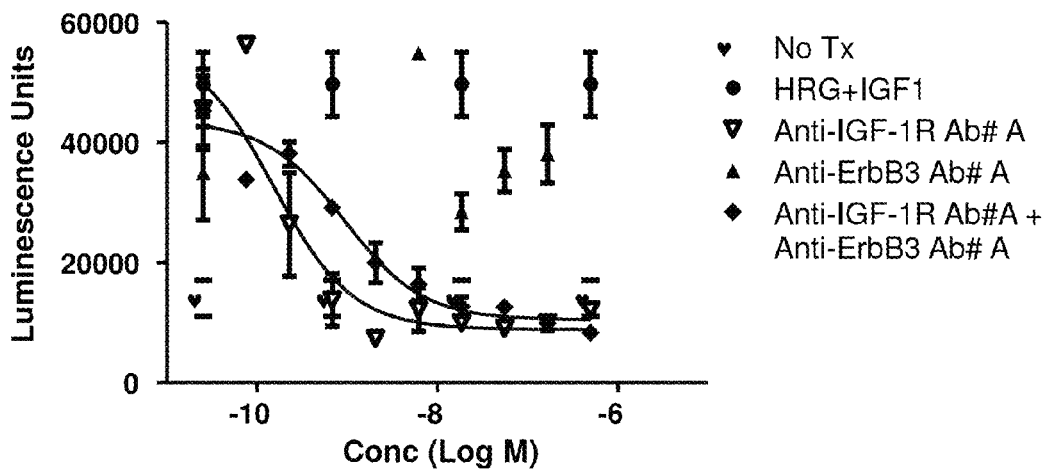
Figure 24E:
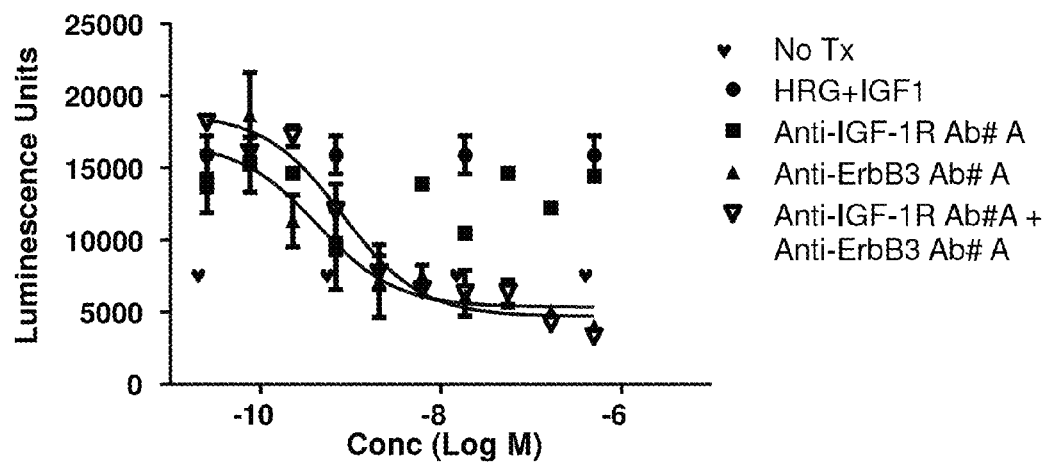
Figure 24F:
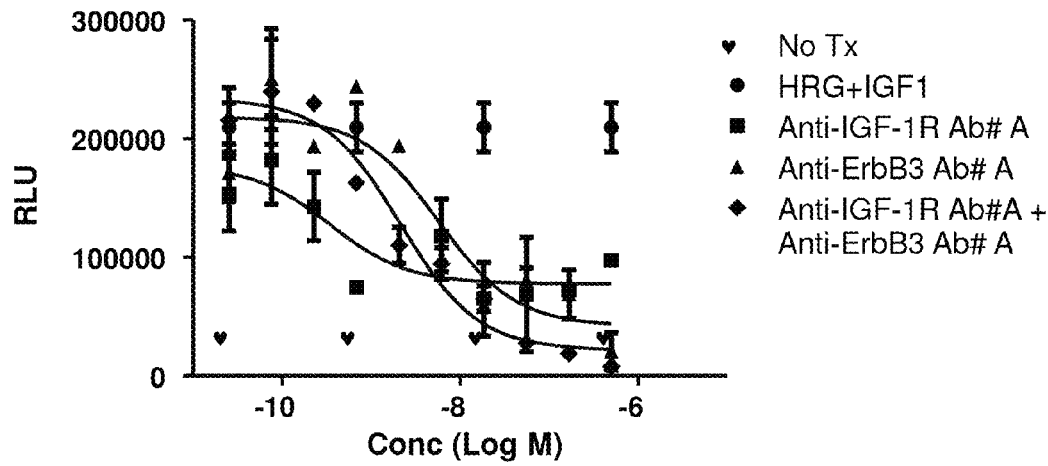

FIG. 22: Reduction of pIGF-1R levels by 16F (SF-G1-C8) "re-engineered bispecific" and ELI-7 "original bispecific" in BcPC3 cells.

FIG. 23: Inhibition by 16F (SF-G1-C8), Anti-IGF-1R Ab#B (cixutumumab; SEQ ID 324+SEQ ID 325), Anti-ErbB3 Ab# A (SEQ ID NO:336+SEQ ID NO:337) or Anti-IGF-1R Ab#B+Anti-ErbB3 Ab# A of phosphorylation of: 23A) IGF1R, 23B) ErbB3, and 23C) AKT, in BxPC-3 cells and inhibition by 16F (SF-G1-C8), Anti-IGF-1R Ab#B (cixutumumab; SEQ ID NO:324+SEQ ID NO:325), Anti-ErbB3 Ab# A (SEQ ID NO:336+SEQ ID NO:337) or Anti-IGF-1R Ab#B+Anti-ErbB3 Ab# A of phosphorylation of: 23D) IGF1R, 23E) ErbB3, and 23F) AKT, in DU145 cells.

FIGS. 24A-F: Signaling inhibition by 16F (SF-G1-C8) (FIGS. 24A-C) compared to ANTI-IGF-1R Ab# A (ganitumab; SEQ ID NO:327+SEQ ID NO:328), anti-ErbB3 Ab# A (SEQ ID NO:336+SEQ ID NO:337) and ANTI-IGF-1R Ab# A+anti-ErbB3 Ab# A (FIGS. 24D-F) Inhibition of phosphorylation of IGF1R is shown in the top graph (FIGS. 24A and D), inhibition of phosphorylation of ErbB3 is shown in the middle graph (FIGS. 24B and E), and inhibition of phosphorylation of AKT is shown in the bottom graph (FIGS. 24C and F); all in BxPC-3 cells.

Figure 25:
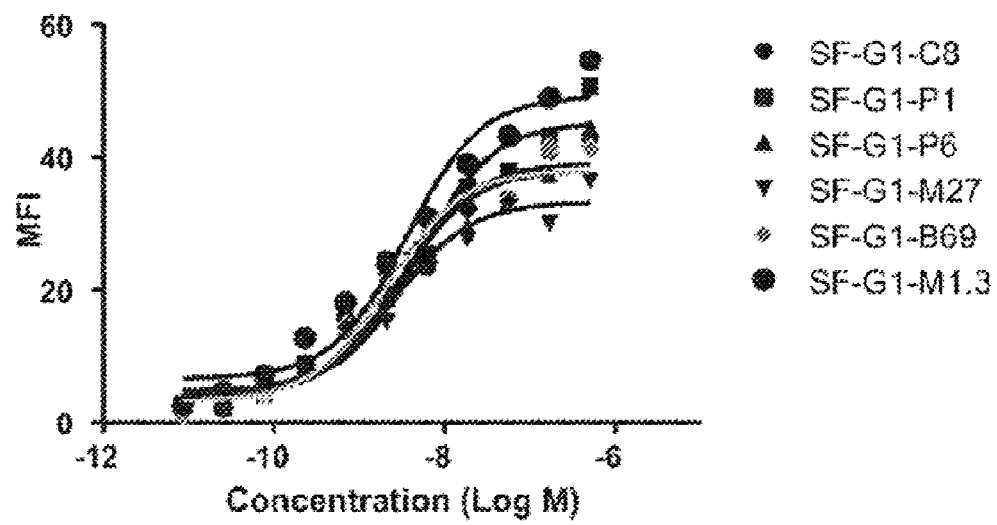

FIG. 25: Bispecific antibodies display strong binding to BxPC-3 cells. Binding curves generated after incubation of indicated antibodies with BxPC-3 cells as measured by FACS.

Figure 26:
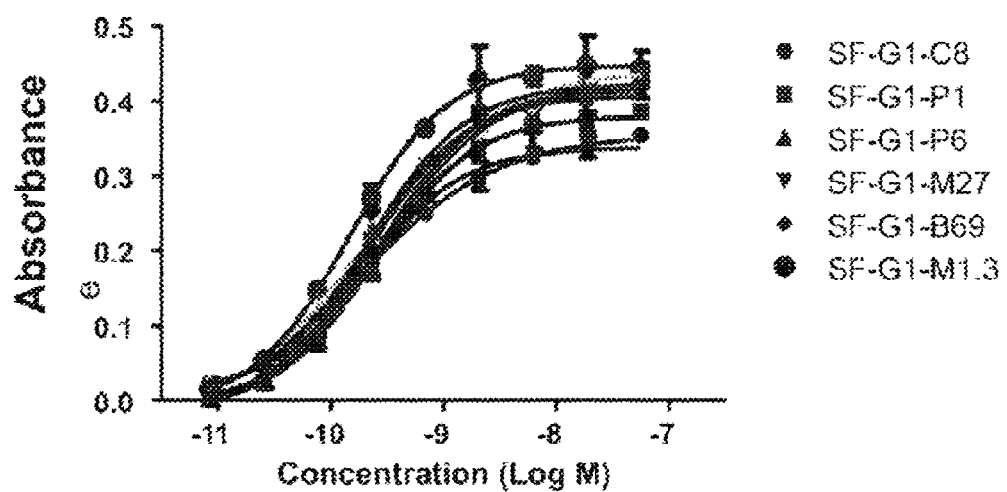

FIG. 26: Bispecific antibodies display strong binding to recombinant ErbB3 protein, Binding curves generated after incubation of indicated antibodies in ErbB3-His-coated plates and measurement of bound antibody levels by ELISA.

Figure 27A:
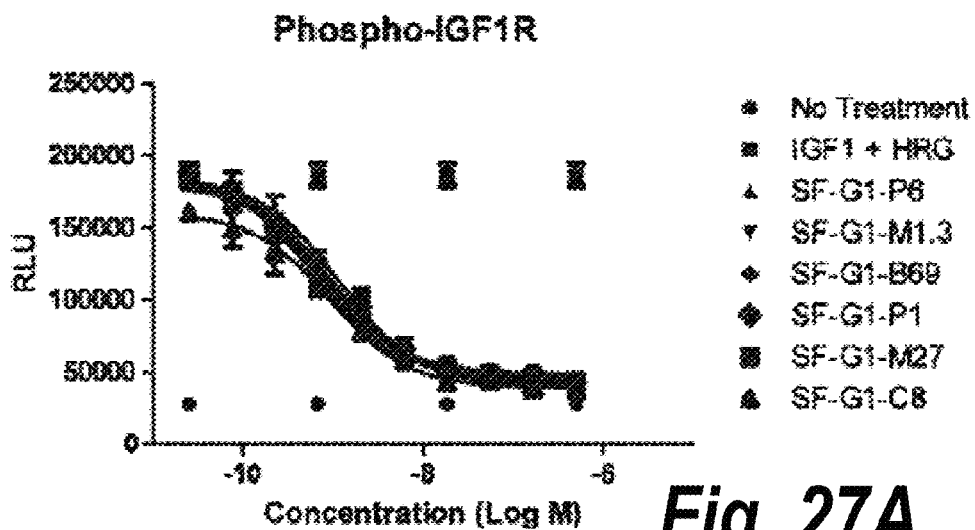
Figure 27B:
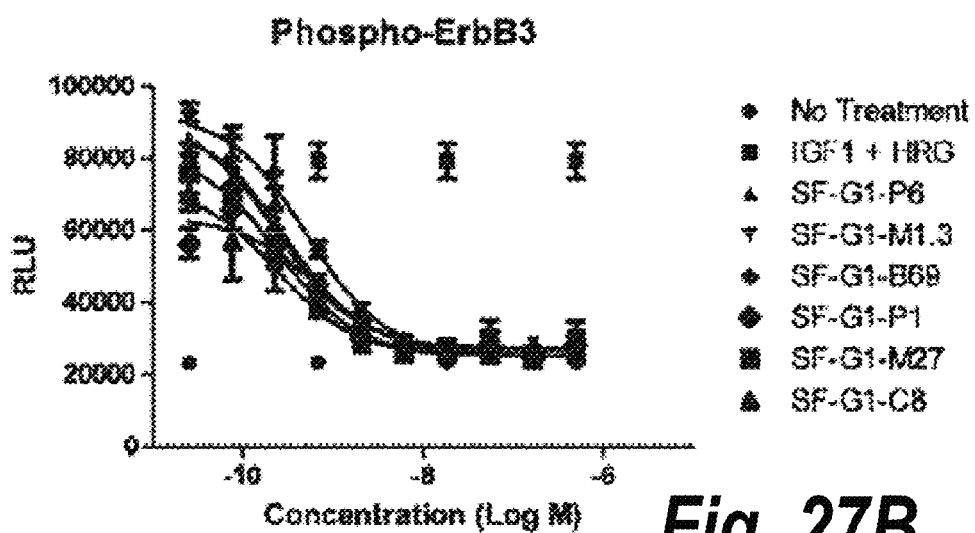
Figure 27C:
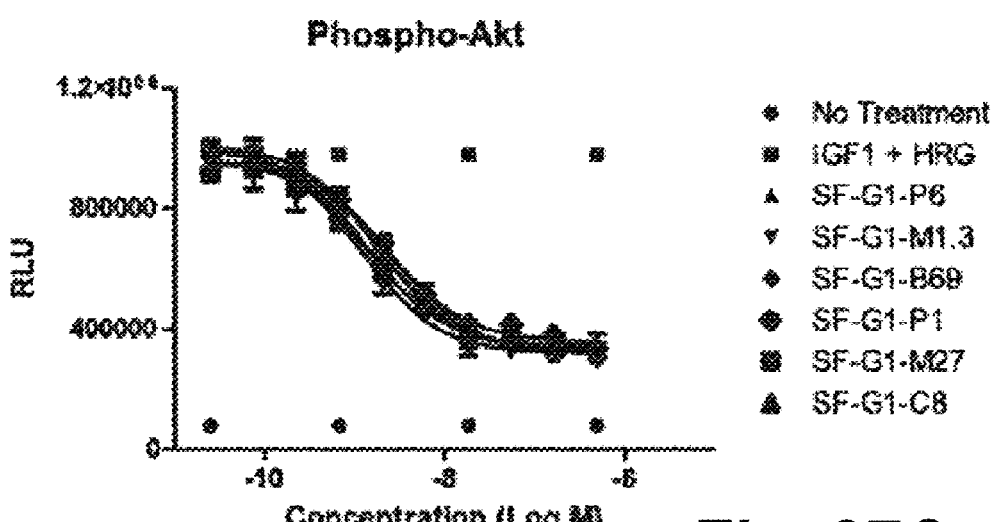

FIGS. 27A-C: Bispecific antibodies display strong inhibition of dual pathway signaling. BxPC-3 signal inhibition of generation of pIGF1R (FIG. 27A), pErbB3 (FIG. 27B), and pAKT (FIG. 27C), as indicated.

Figure 28:
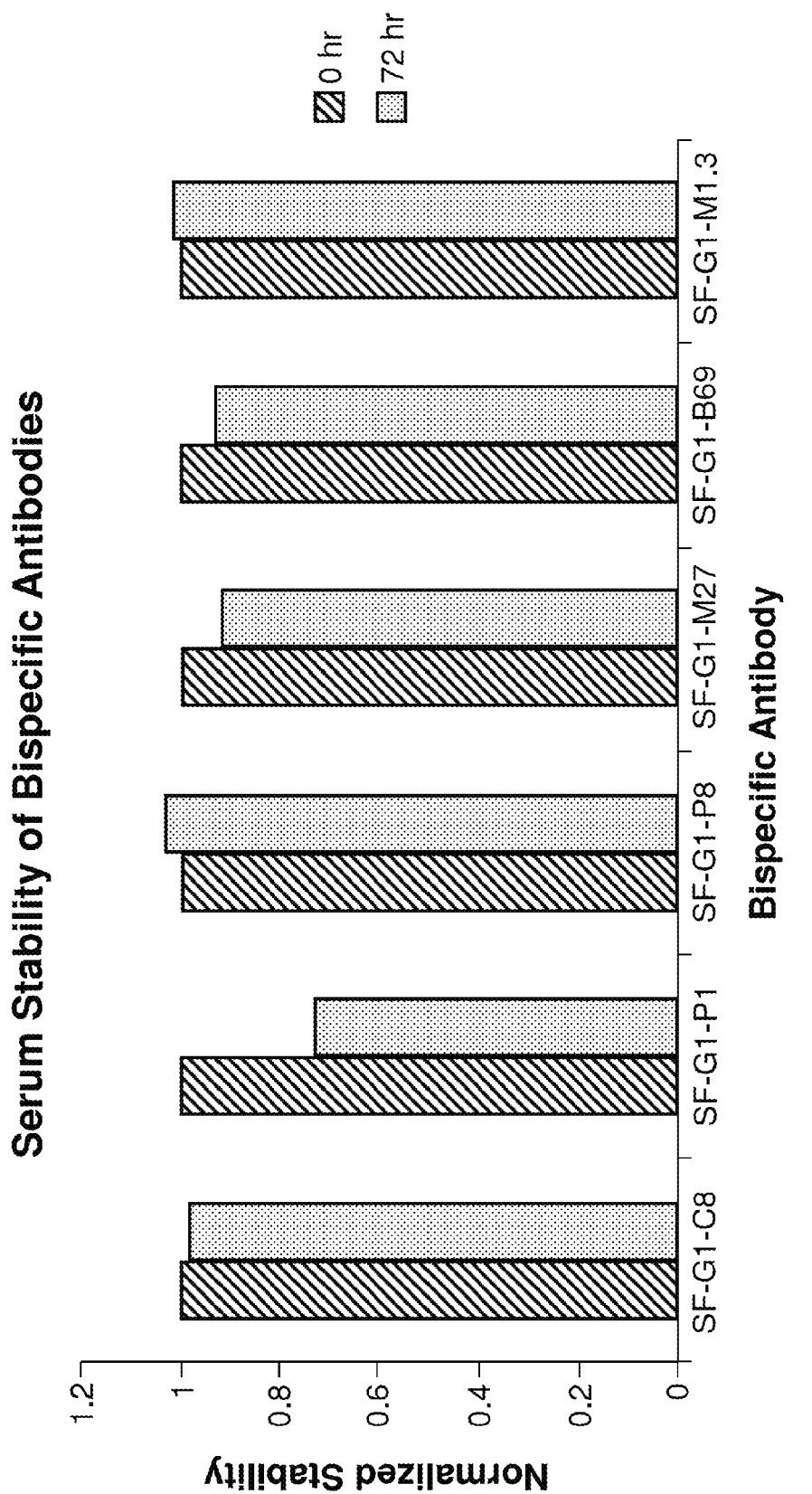

FIG. 28: Percent stability of indicated bispecific antibodies in serum for 72 hrs at 37° C.

FIG. 29: A-D show the binding of various bispecific antibodies (as indicated) to BxPC-3 cells as measured by FACS. In 29A), the N-terminal modules of M27/M7-IgG-P4, M27/

M7-IgG-M57, and M27/M7-IgG-M78 bispecific antibodies contain the M27 heavy chain and the M7 light chain.

FIGS. 30A-I: show BxPC-3 signal inhibition data for various bispecific antibodies (as indicated) as measured by changes in pIGF1R levels.

FIGS. 31A-K: show BxPC-3 signal inhibition data for various bispecific antibodies (as indicated) as measured by changes in pErbB3 levels.

FIGS. 32A-I: show BxPC-3 signal inhibition data for various bispecific antibodies (as indicated) as measured by changes in pAKT levels.

FIG. 33: A-D show BxPC-3 signal inhibition data for various bispecific antibodies (as indicated) compared to a combination of anti-ErbB3 Ab# A (SEQ ID NO:336+SEQ ID NO:337) and ANTI-IGF-1R Ab# A (ganitumab; SEQ ID NO:327+SEQ ID NO:328), as measured by changes in pIGF1R levels.

FIG. 34: A-D show BxPC-3 signal inhibition data for various bispecific antibodies (as indicated) compared to a combination of anti-ErbB3 Ab# A (SEQ ID NO:336+SEQ ID NO:337) and ANTI-IGF-1R Ab# A (ganitumab; SEQ ID NO:327+SEQ ID NO:328), as measured by changes in pErbB3 levels.

FIG. 35: A-D show BxPC-3 signal inhibition data for various bispecific antibodies compared to a combination of anti-ErbB3 Ab# A (SEQ ID NO:336+SEQ ID NO:337) and ANTI-IGF-1R Ab# A (ganitumab; SEQ ID NO:327+SEQ ID NO:328), as measured by changes in pAKT levels.

Figure 36A:
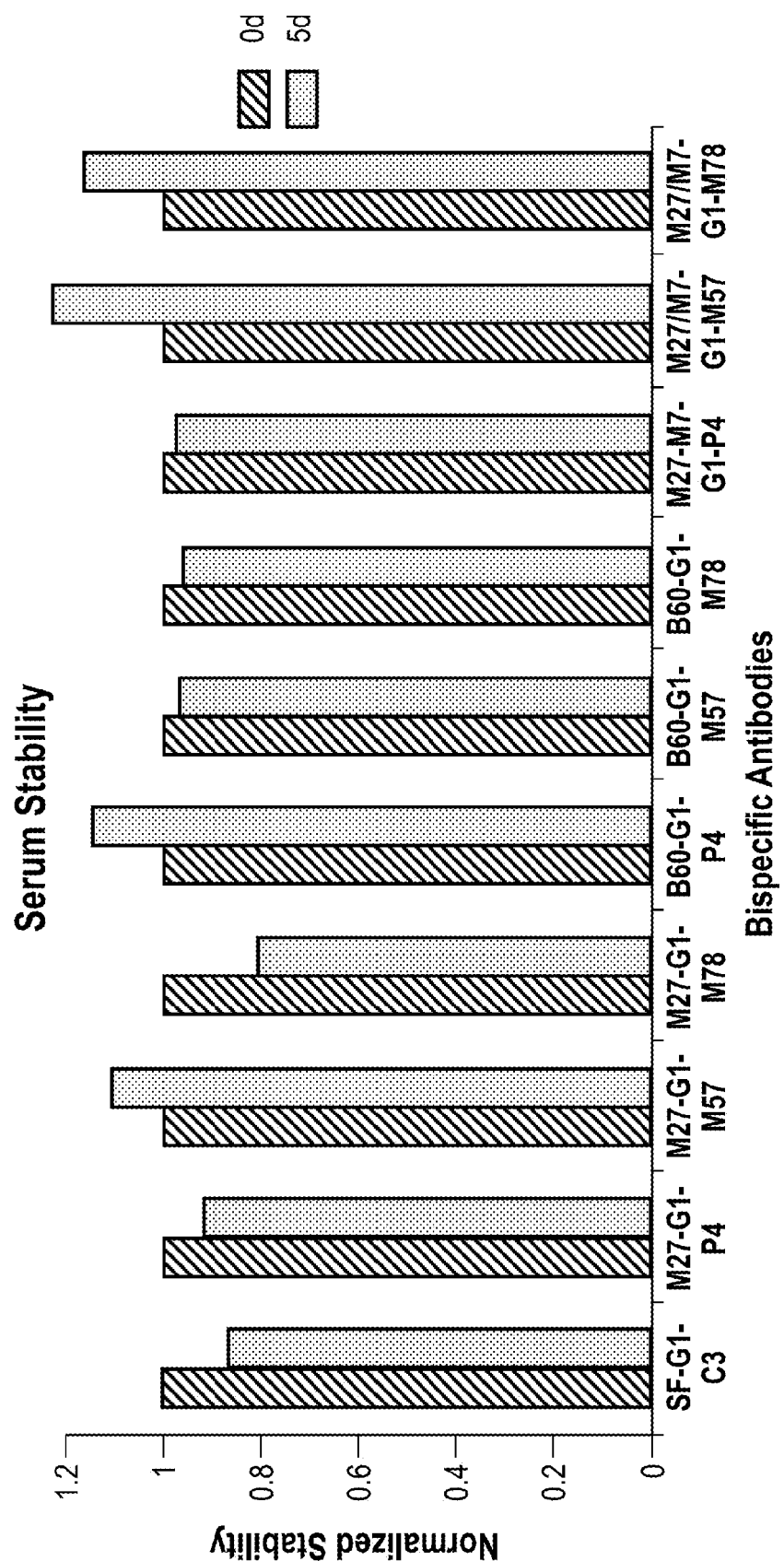
Figure 36B:
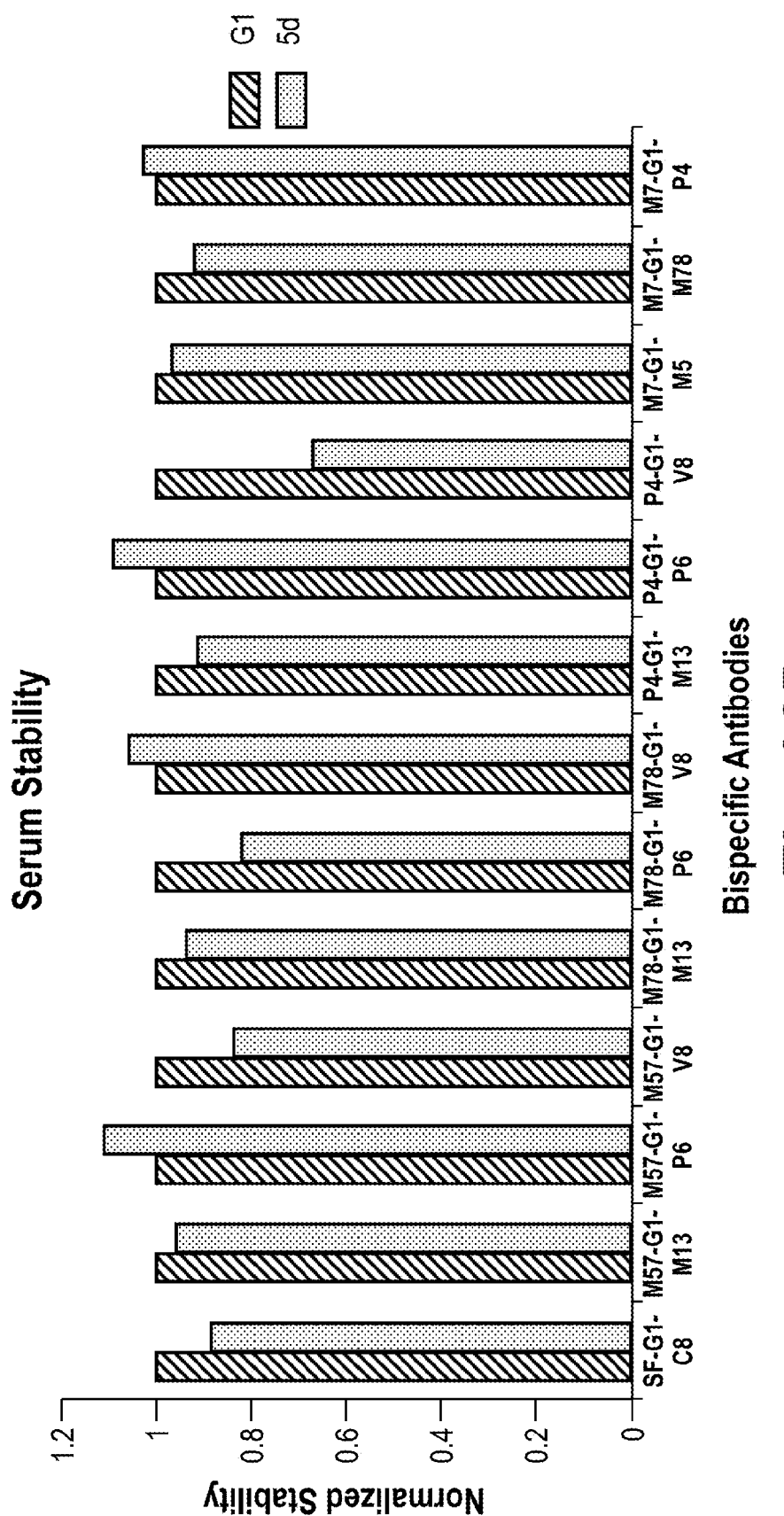

FIG. 36: A-B show normalized stability for various bispecific antibodies (as indicated) in mouse serum for 5 days at 37° C.

FIGS. 37A-C: Published aa sequences of heavy chains, light chains and scFvs of anti-IGF-1R antibodies that may be incorporated into polyvalent bispecific antibodies in accordance with the disclosure herein.

FIGS. 38A-D: Published aa sequences of heavy chains, light chains and scFvs of anti-ErbB3 antibodies to be incorporated into polyvalent bispecific antibodies in accordance with the disclosure herein.

Figure 39A:
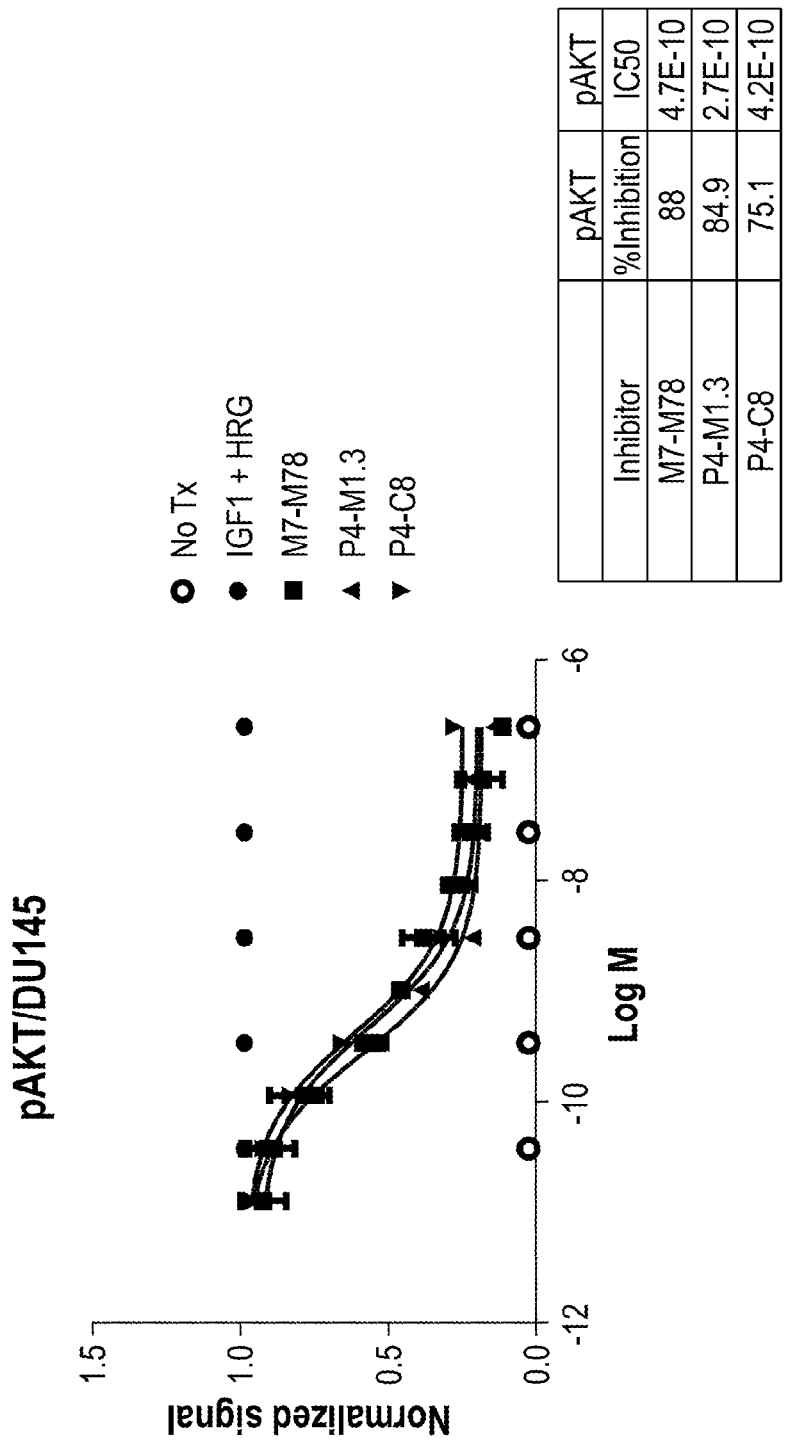
Figure 39C:
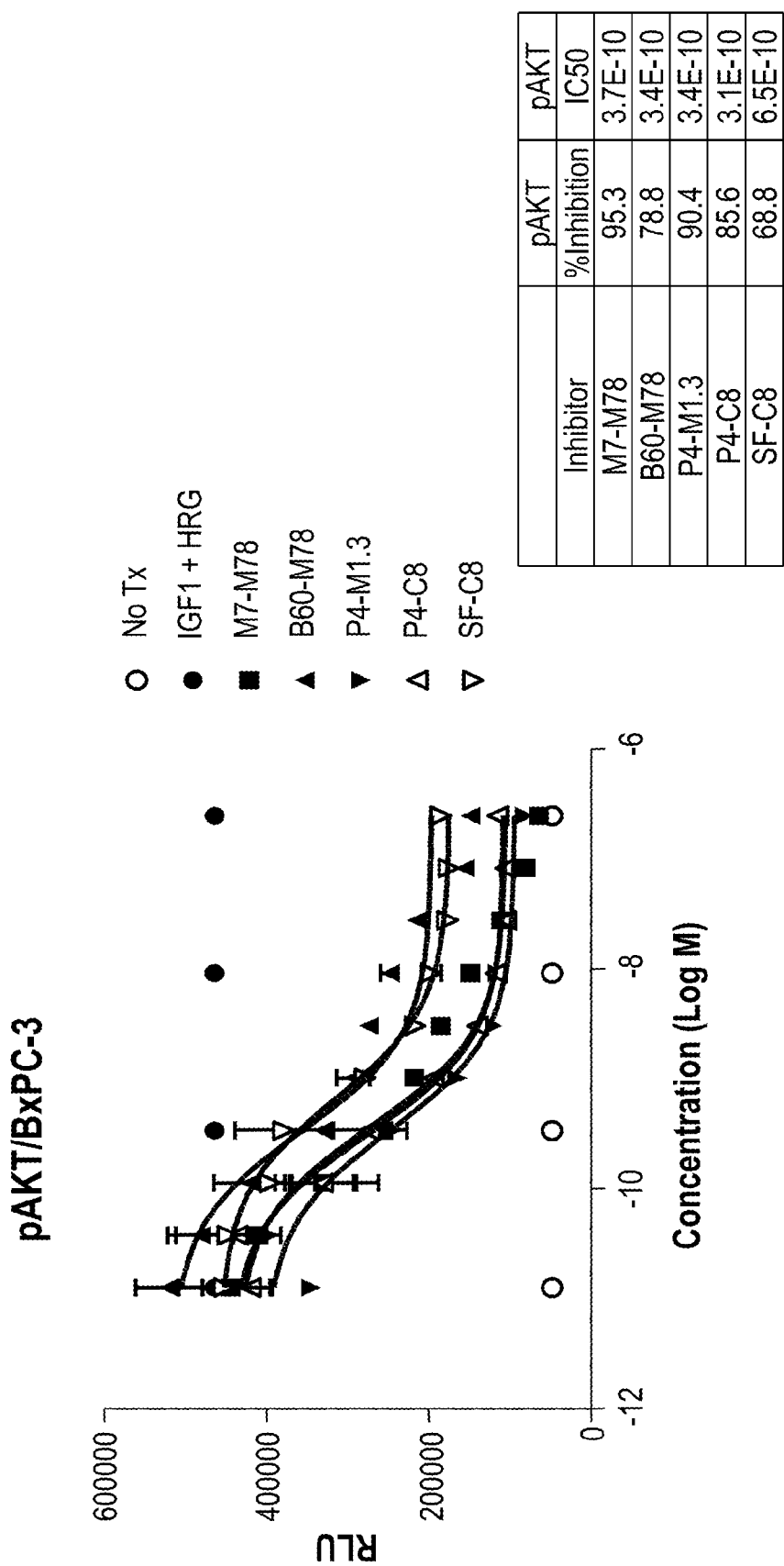
Figure 39D:
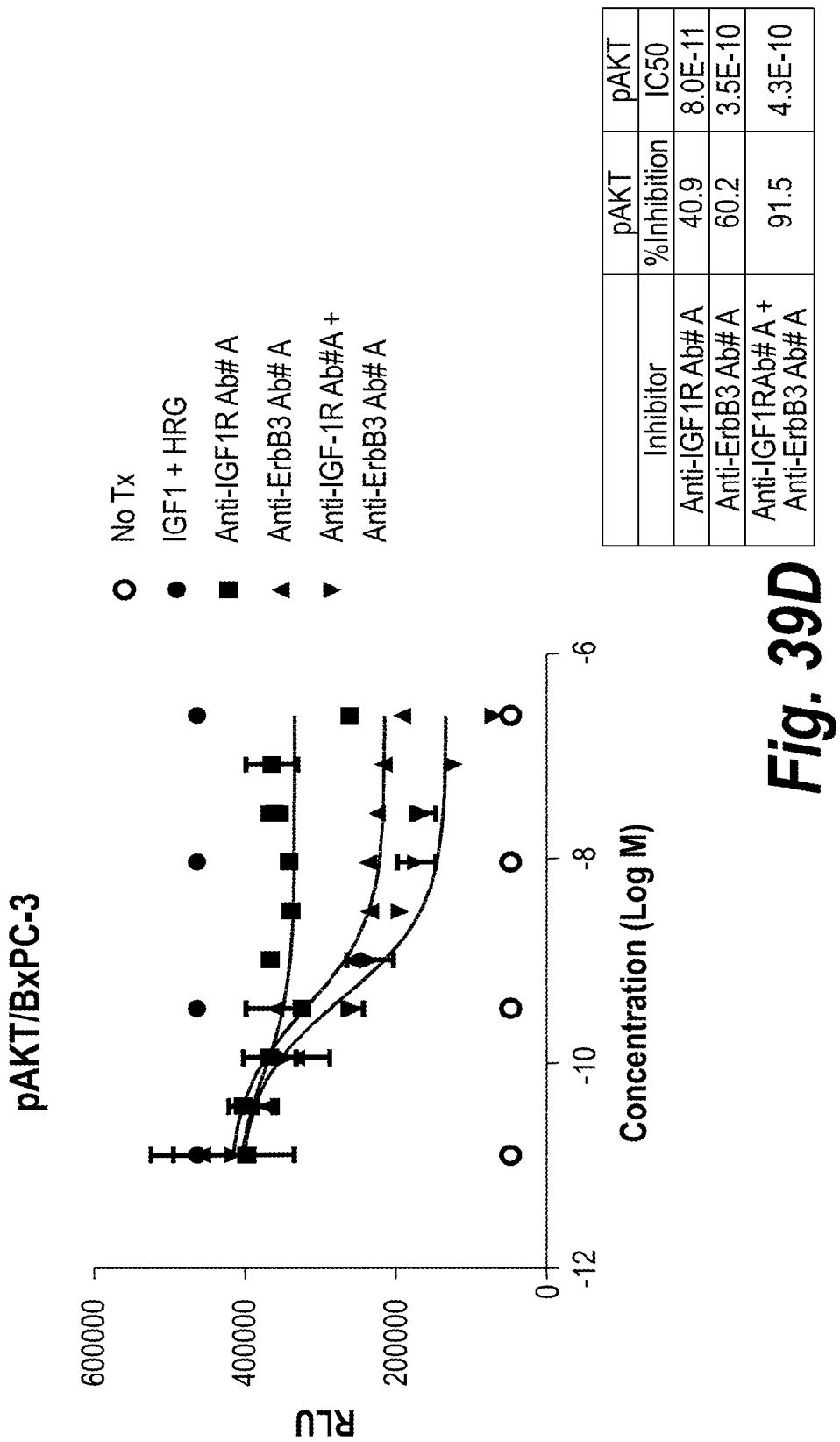
Figure 40A:
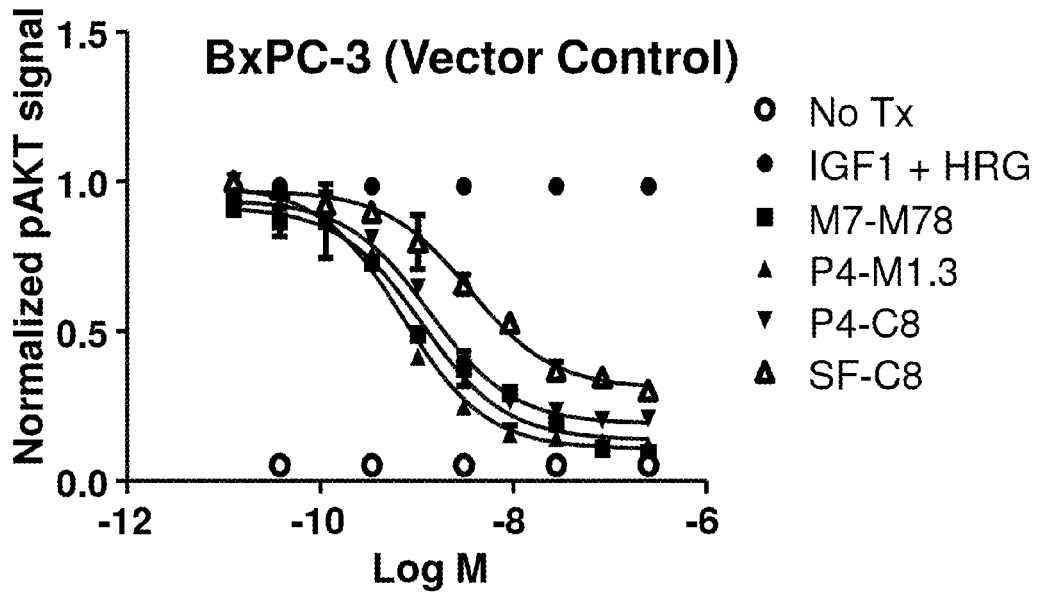
Figure 40B:
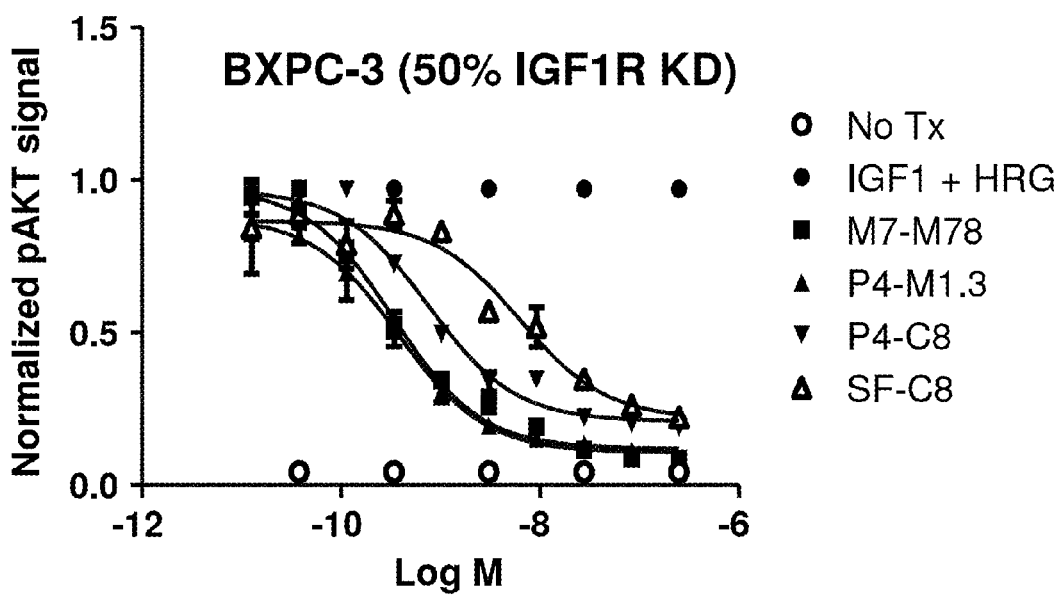
Figure 40C:
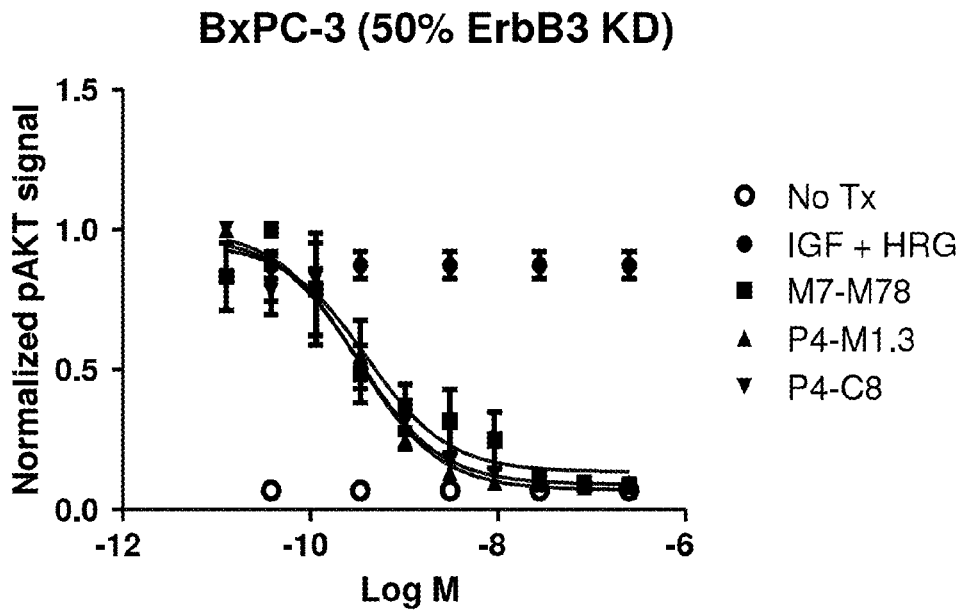
Figure 40D:
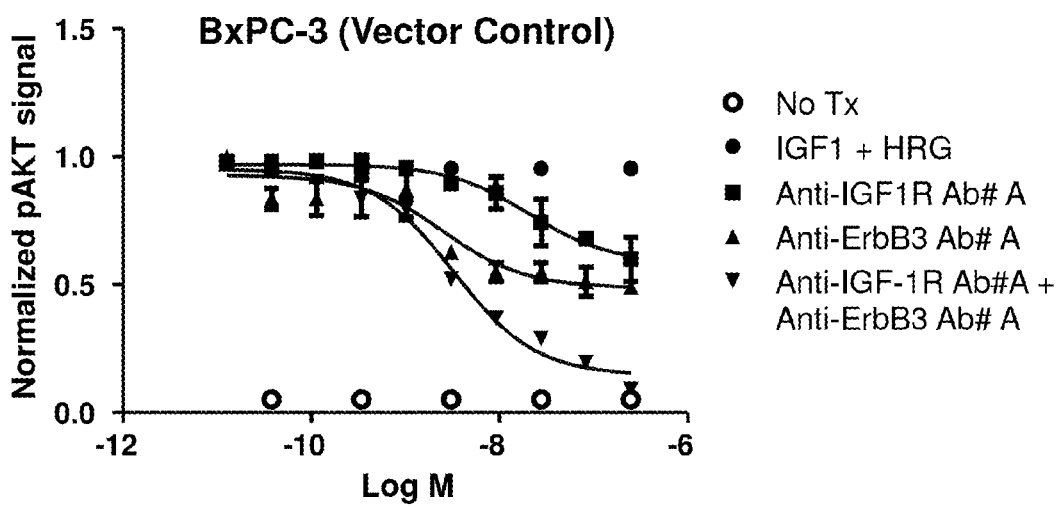
Figure 40E:
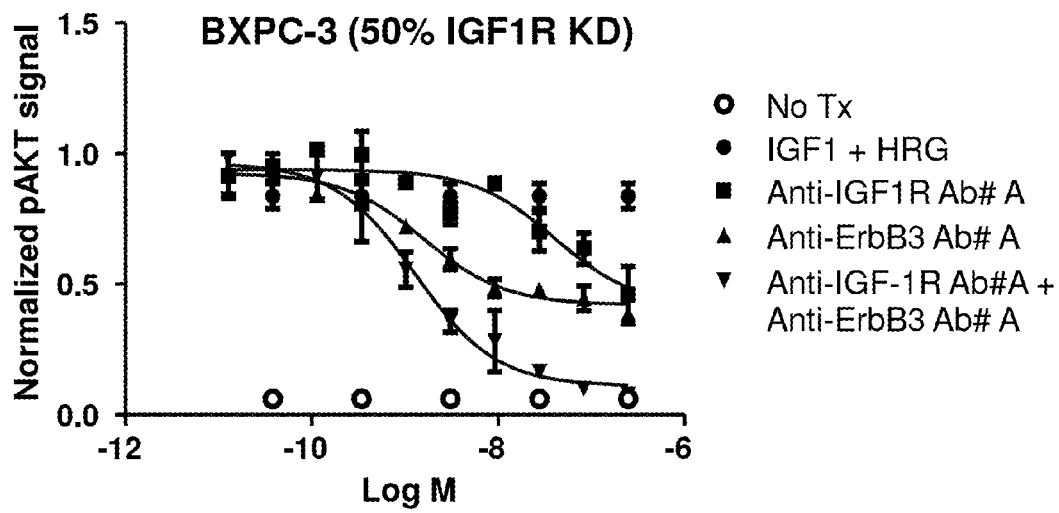
Figure 40F:
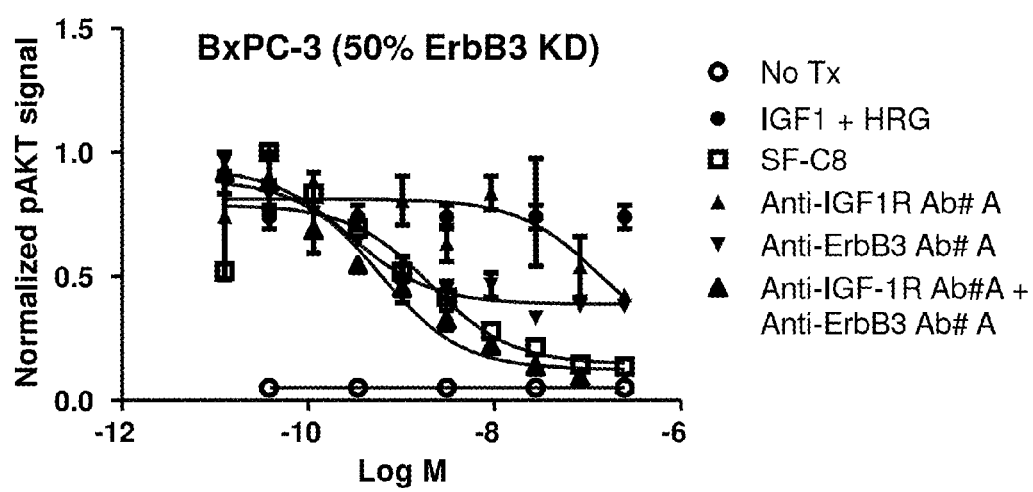
Figure 41A:
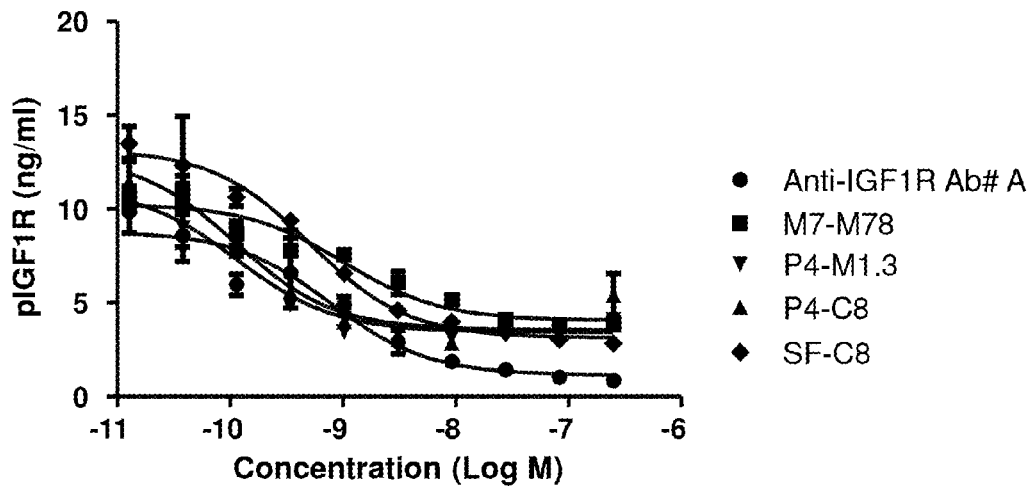
Figure 41B:
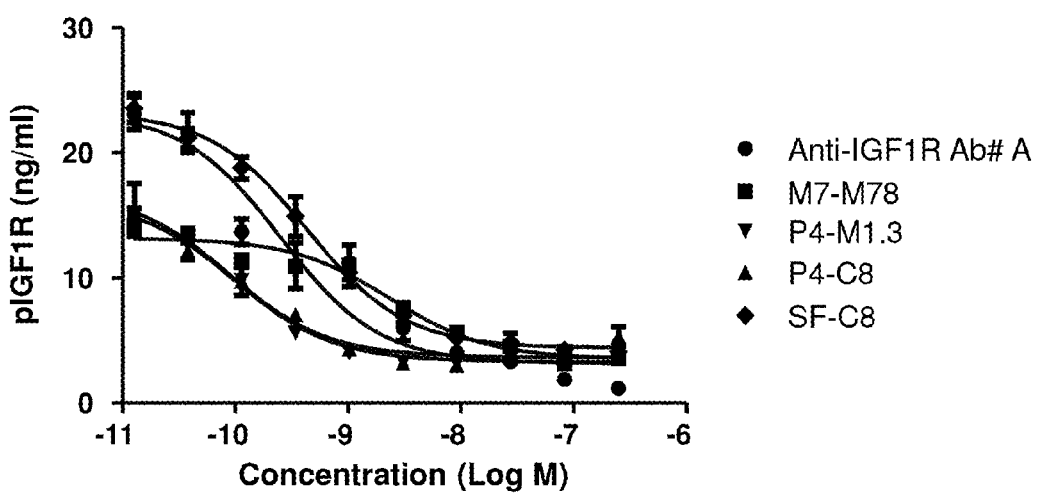
Figure 41C:
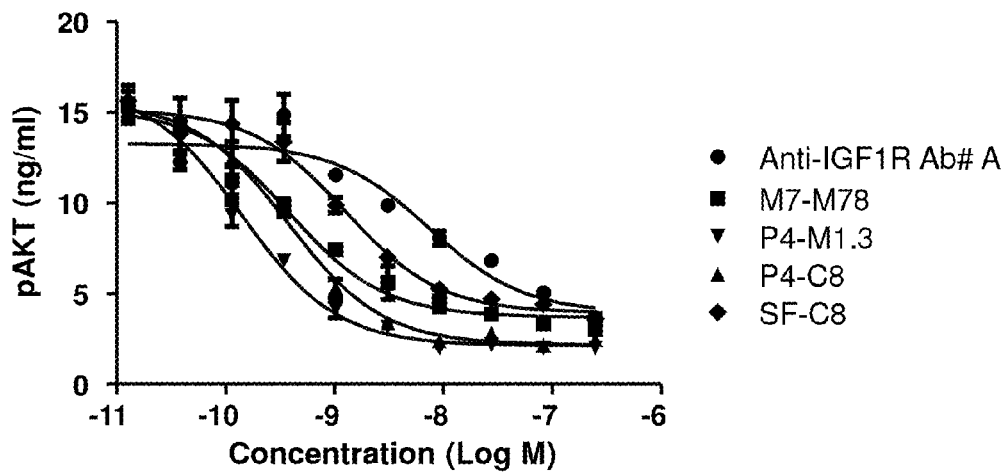
Figure 41D:
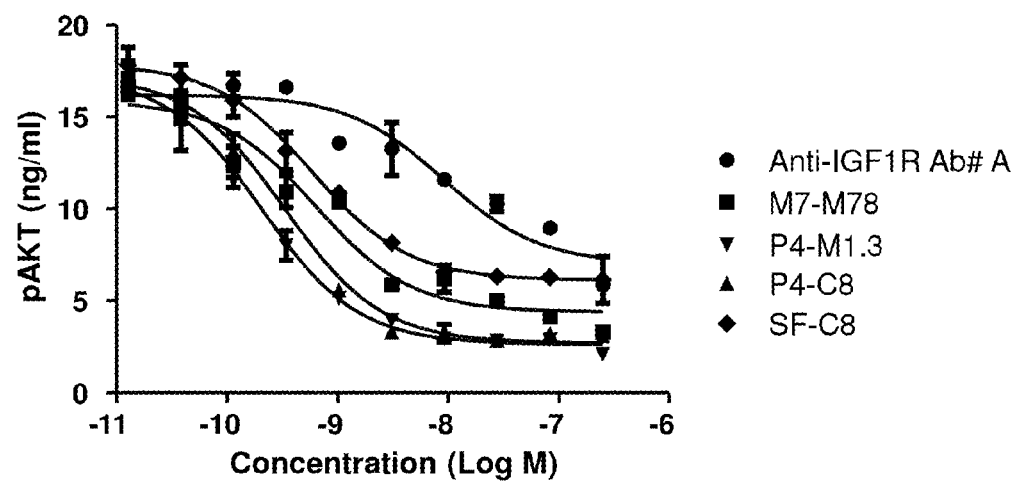
Figure 42A:
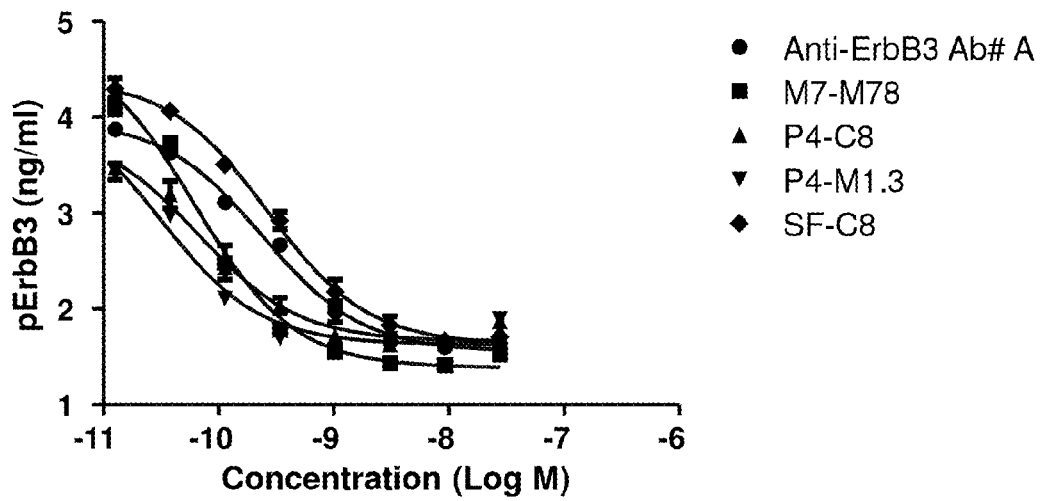
Figure 42B:
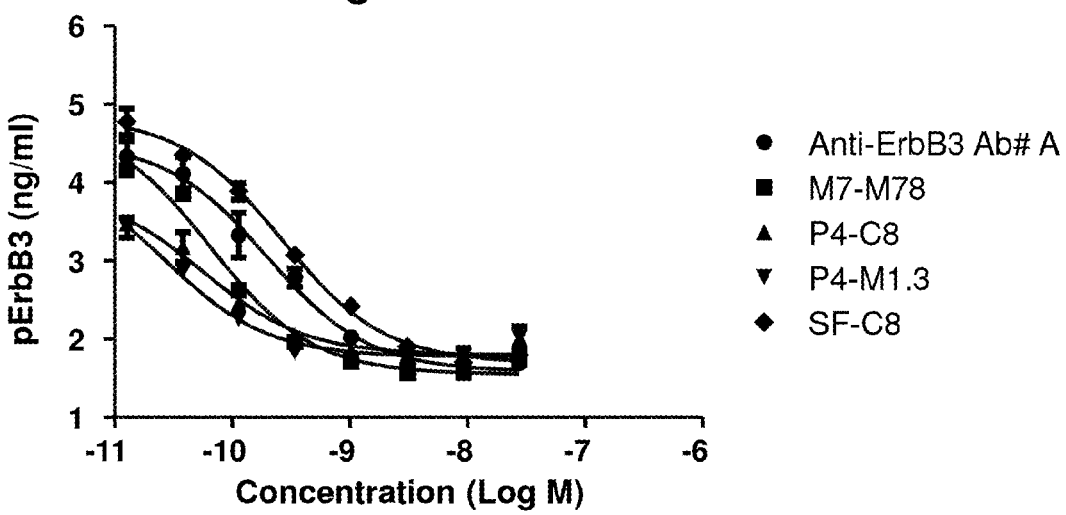
Figure 42C:
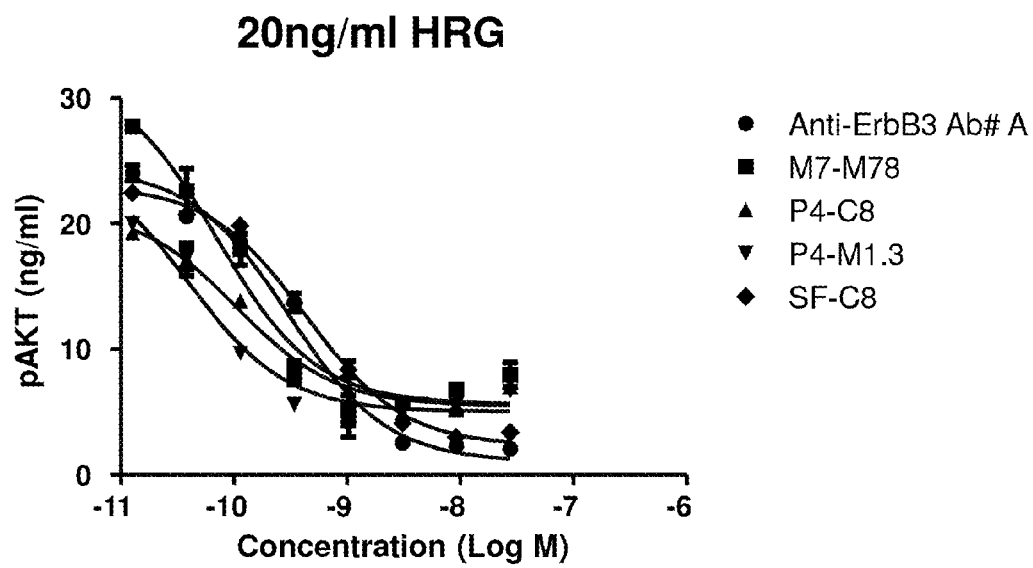
Figure 42D:
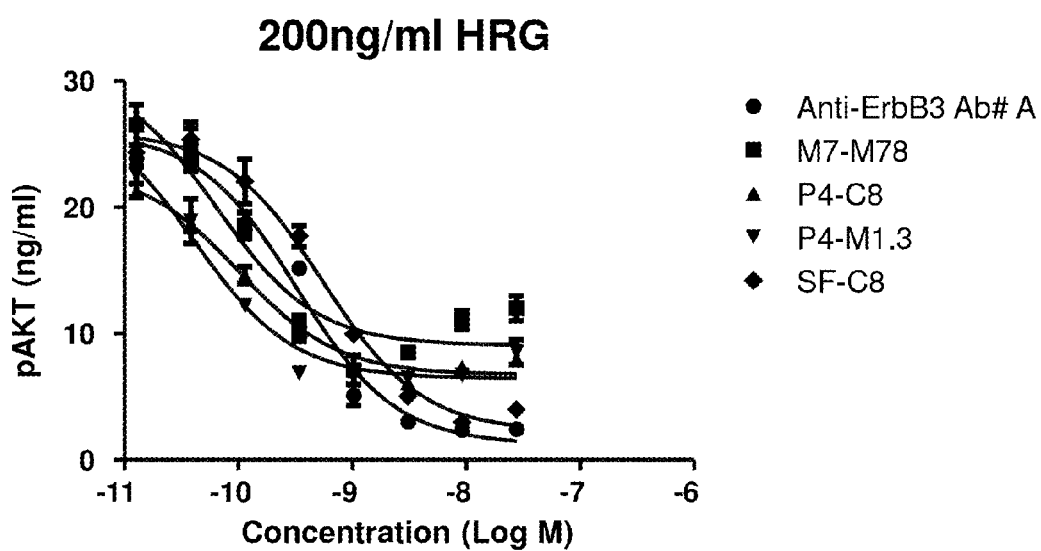
Figure 43A:
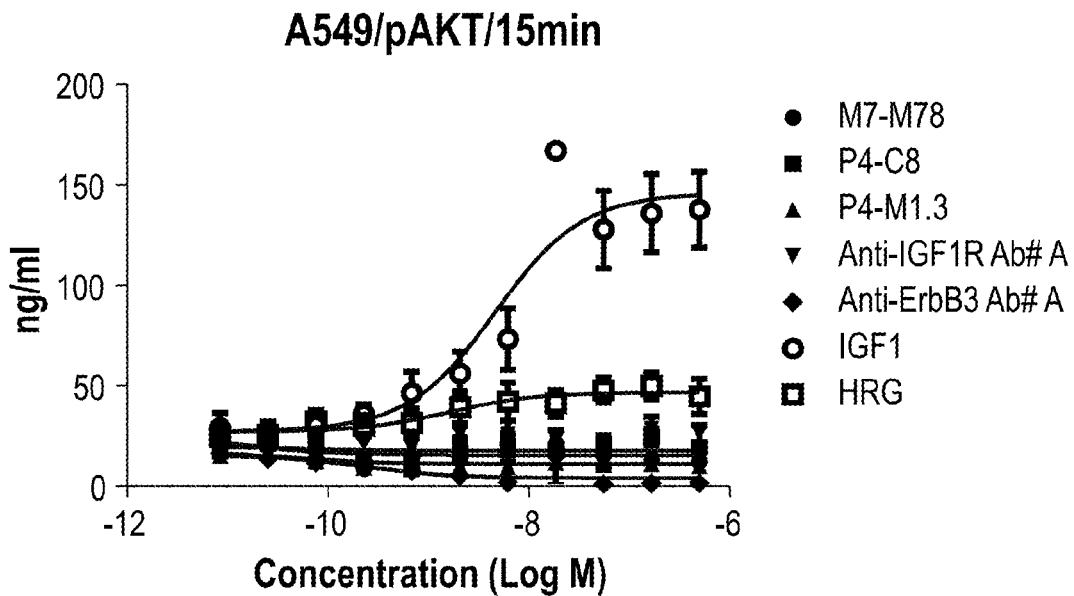
Figure 43B:
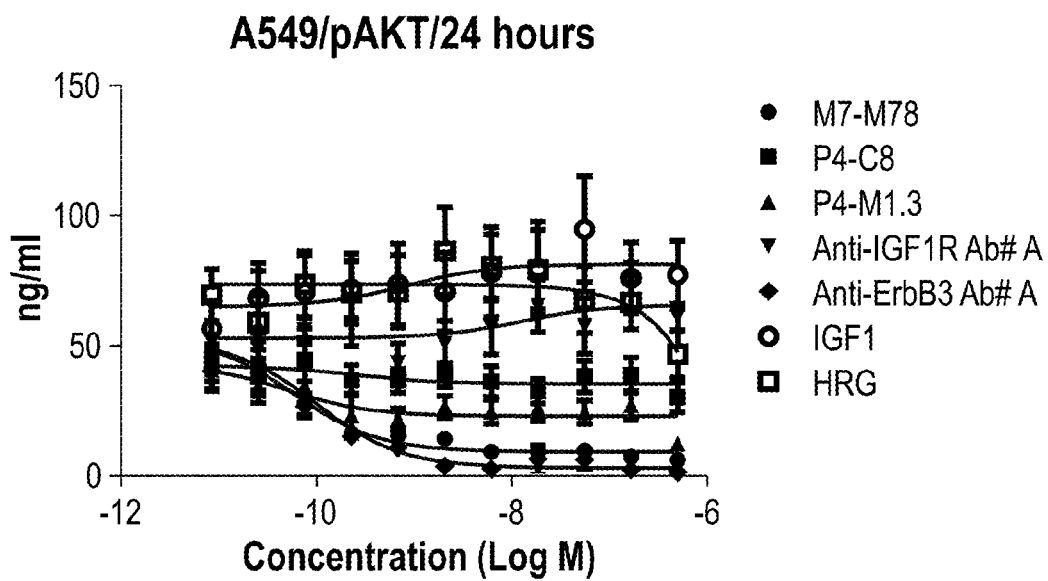
Figure 43C:
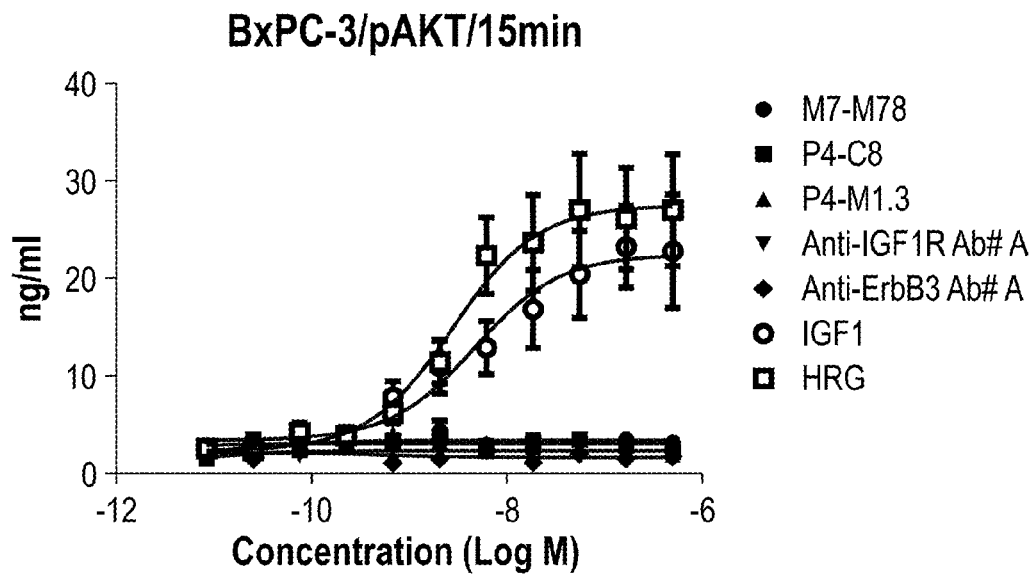
Figure 43D:
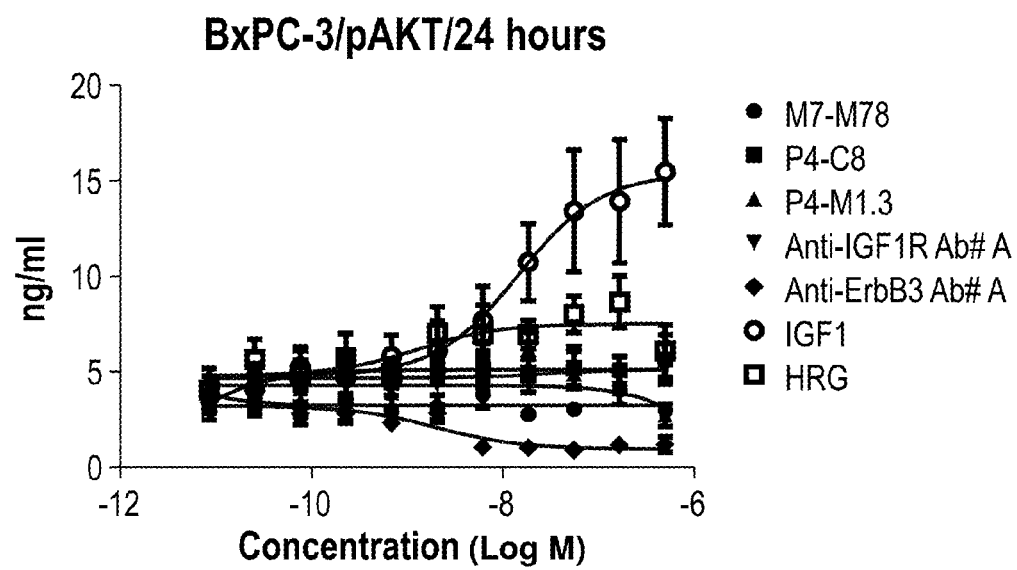

FIG. 39: A-B show inhibition of IGF1 and heregulin (HRG) signal transduction in DU145 cells by the PBAs A) M7-G1-M78 ("M7-M78"), P4-G1-M1.3 ("P4-M1.3"), P4-G1-C8 ("P4-C8") and B) SF-G1-C8 ("SF-C8") compared to the absence of PBAs ("IGF1+HRG"); the absence of inducer and PBA ("No Tx"); anti-EGF1R mAB alone; anti-ErbB3 mAb alone; and a combination of anti-IGF-1R+anti-ErbB3, as measured by inhibition of phosphorylation of AKT. C-D show inhibition data obtained similarly to that in A-B, but in BxPC-3 cells. Anti-IGF1R and anti-ErbB3 mAbs in this FIG. and in FIGS. 40-44 and 51 are ANTI-IGF-1R Ab# A (ganitumab; SEQ ID NO:327+SEQ ID NO:328) and anti-ErbB3 Ab# A (SEQ ID NO:336+SEQ ID NO:337), respectively.

FIG. 40: A-C show inhibition of IGF1 and heregulin (HRG) induced signal transduction by the PBAs M7-G1-M78, P4-M1.3, P4-C8 and SF-C8 in BxPC-3 cells which have A-D) wild type levels of IGF-1R and ErbB3; B-E) levels of IGF-1R reduced by about 50%; or C-F) levels of ErbB3 reduced by about 50%, as measured by inhibition of phosphorylation of AKT.

FIG. 41: A-D show inhibition of signal transduction induced by A-B) 40 ng/ml of IGF1 or C-D) or 400 ng/ml IGF1 by the PBAs M7-G1-M78, P4-M1.3, P4-C8 and SF-C8 in BxPC-3 cells, as measured by inhibition of phosphorylation of AKT.

FIG. 42: A-D show inhibition of signal transduction induced by A-B) 20 ng/ml of IGF1 or C-D) or 200 ng/ml heregulin (HRG) by the PBAs M7-G1-M78, P4-M1.3, P4-C8 and SF-C8 in BxPC-3 cells, as measured by inhibition of phosphorylation of AKT.

FIG. 43: A-B show inhibition of basal signaling in A549 cells after A) 15 minutes incubation with the PBAs M7-G1-M78, P4-M1.3, P4-C8 and SF-C8; or B) 24 hours incubation with the PBAs. C-D show inhibition of basal signaling in BsPC-3 cells after C) 15 minutes incubation with the PBAs M7-G1-M78, P4-M1.3, P4-C8 and SF-C8; or D) 24 hours incubation with the PBAs. All signaling is determined by measuring pAKT levels.

Figure 44A:
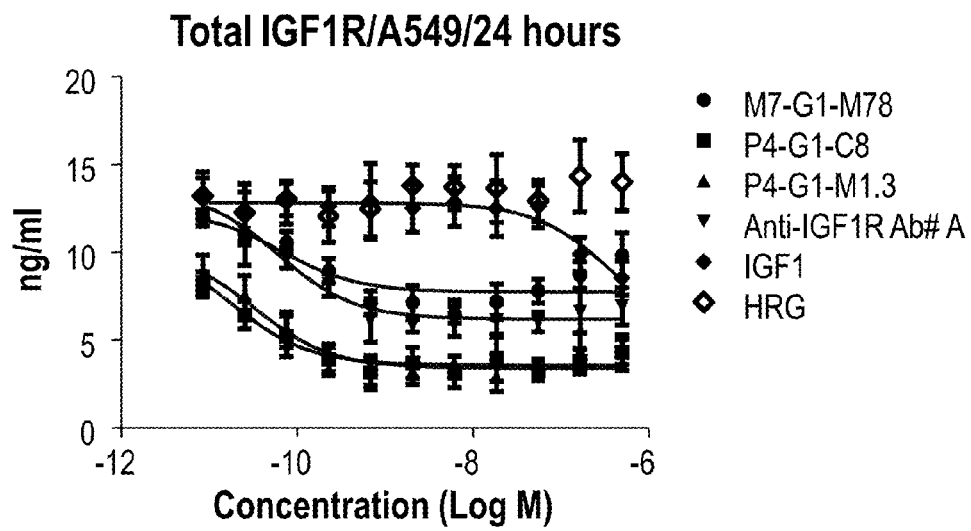
Figure 44B:
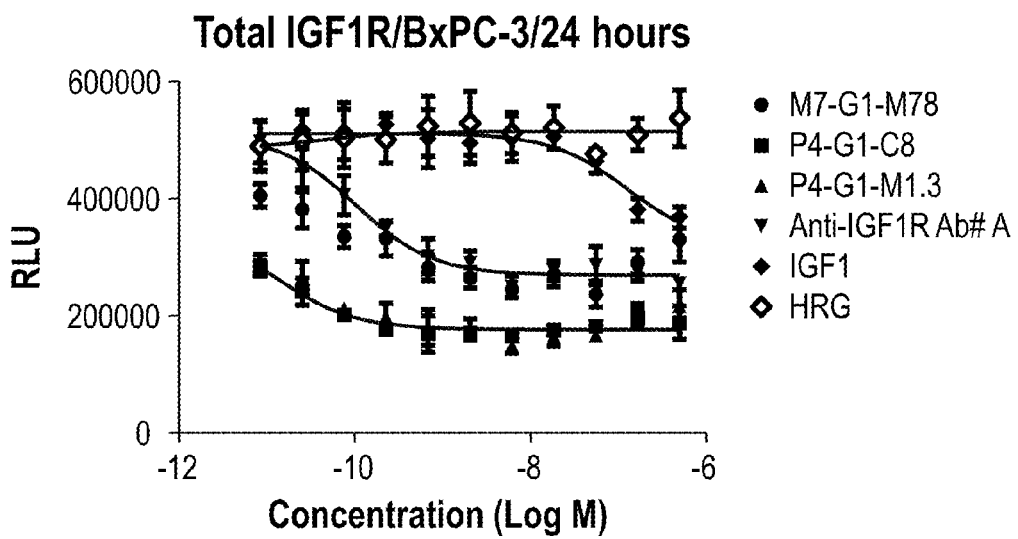

FIGS. 44A-B: show the total IGF1R level in A549 cells (FIG. 44A) and BxPC-3 cells (FIG. 44B), after 24 hours of treatment with P4-G1-C3 or P4-G1-M1.3.

Figure 45:
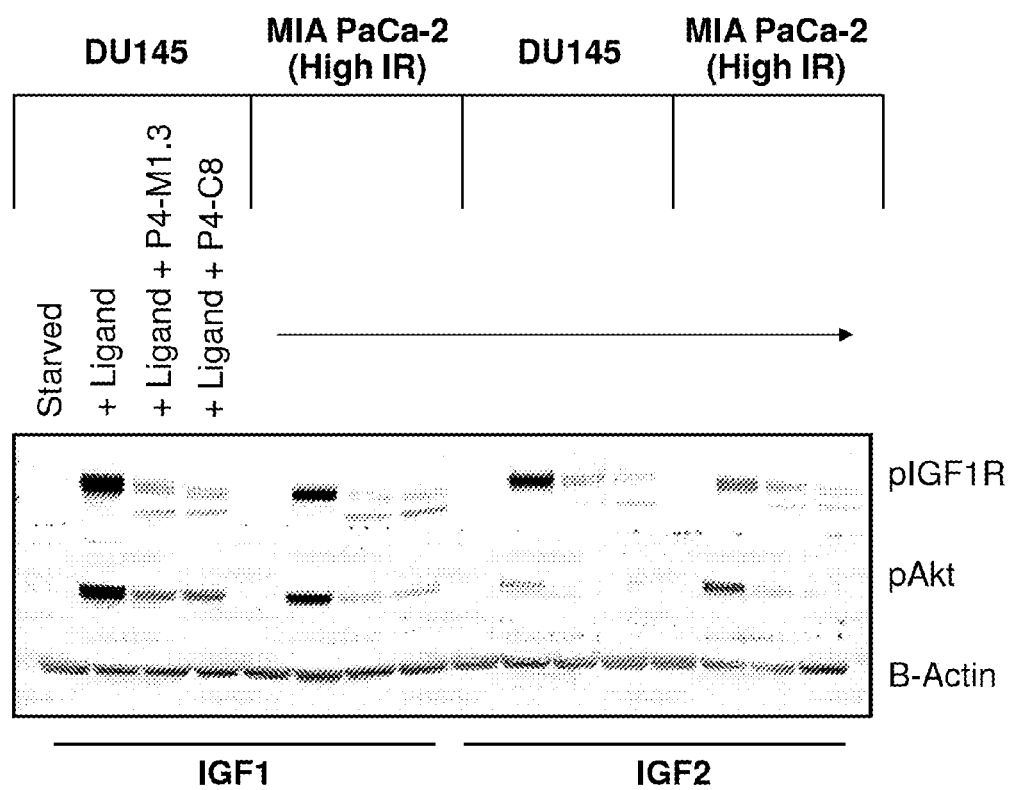

FIG. 45: Western blot showing the protein level of pIGF1R, pAKt, and B-Actin in DU145 or MIA PaCa-2 (High IR) cells that were serum starved ("Starved") or treated with IGF1 or IGF2 alone or in the presence of the PBA P4-M1.3 or P4-C8.

Figure 46:
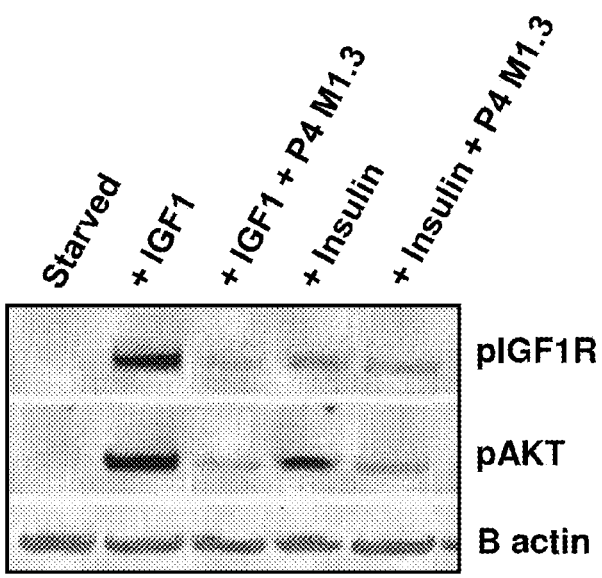

FIG. 46: Western blot showing the protein level of pIGF1R, pAKt, and B-Actin in DU145 cells that were serum starved ("Starved") or treated with IGF1; IGF1 in the presence of P4-M1.3; insulin or insulin in the presence of P4-M1.3.

Figure 47:
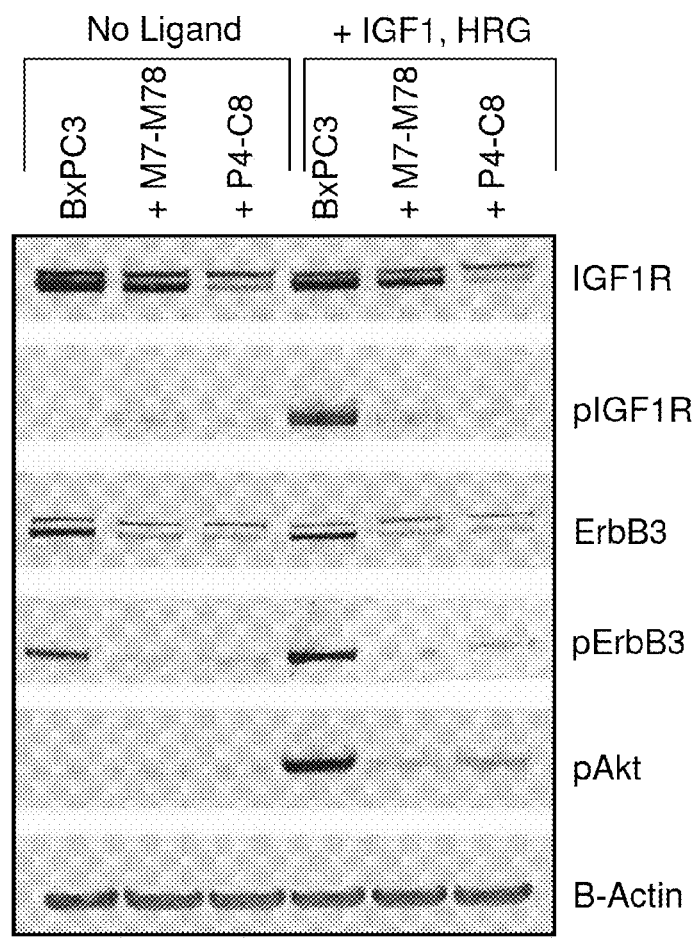
Figure 48A:
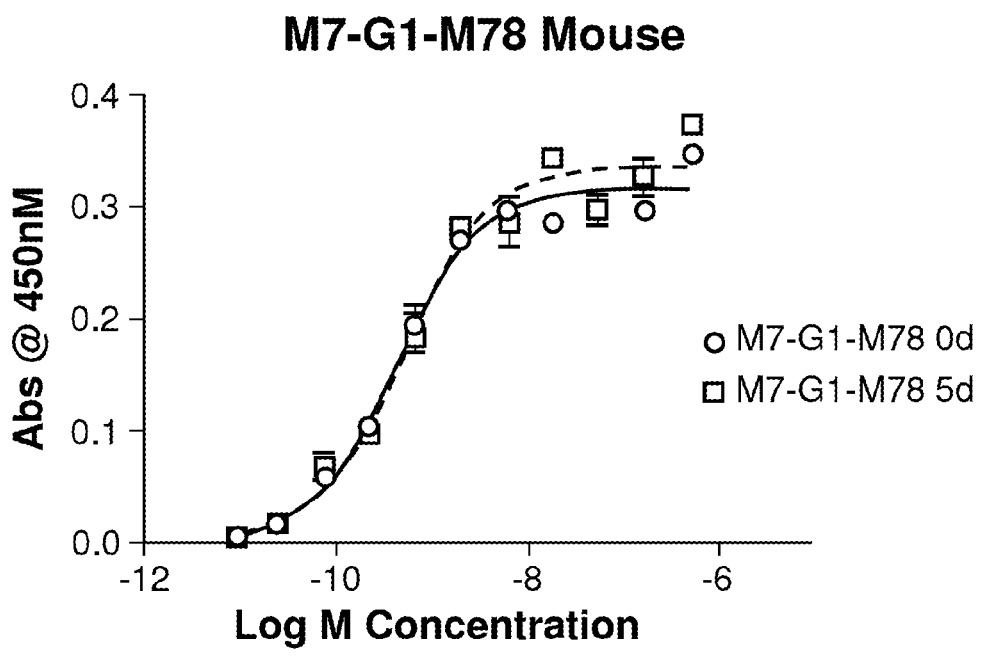
Figure 48B:
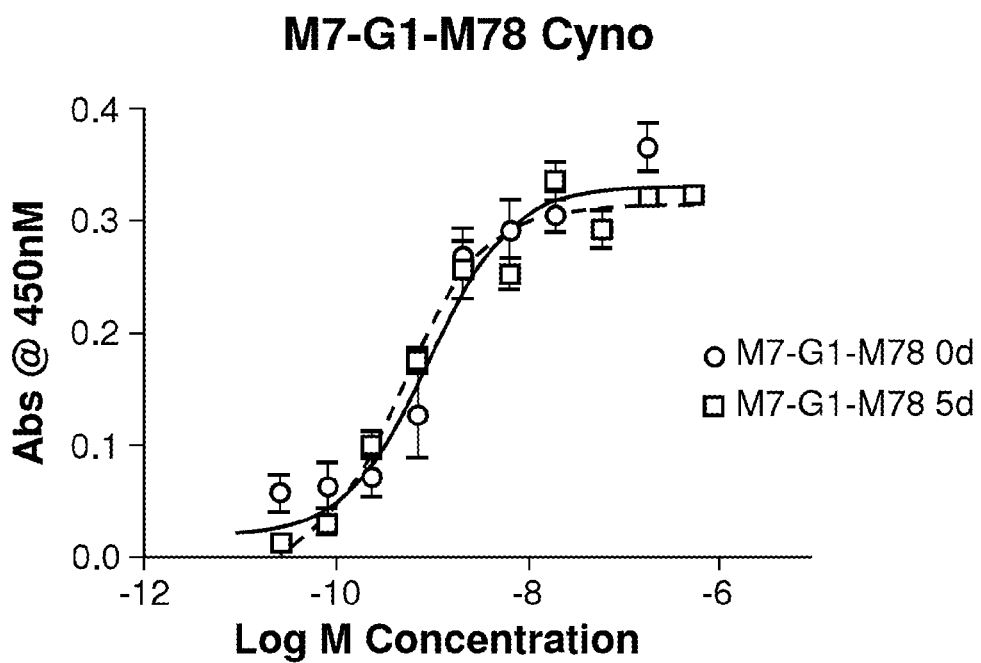
Figure 48C:
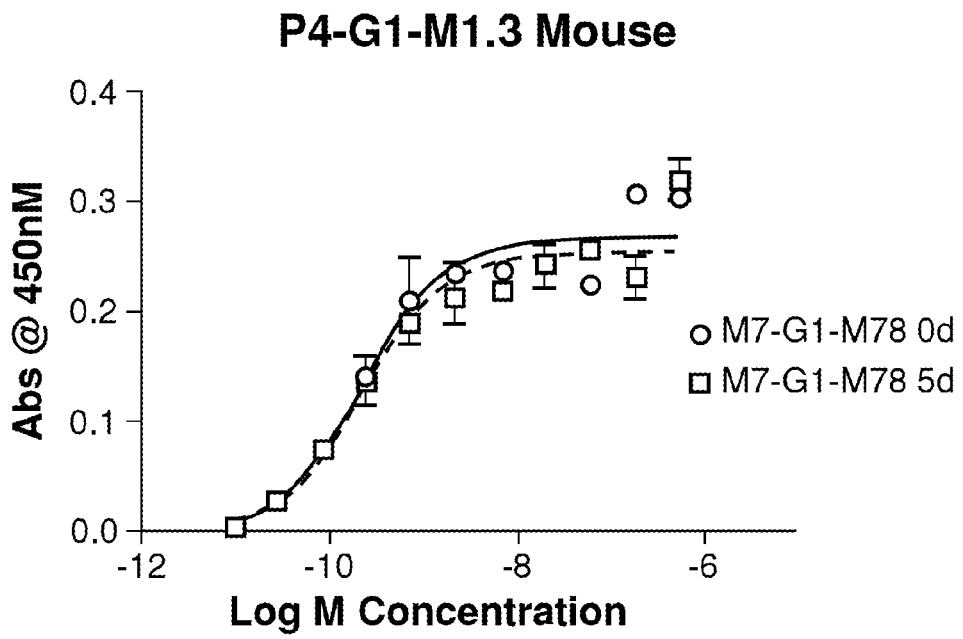
Figure 48D:
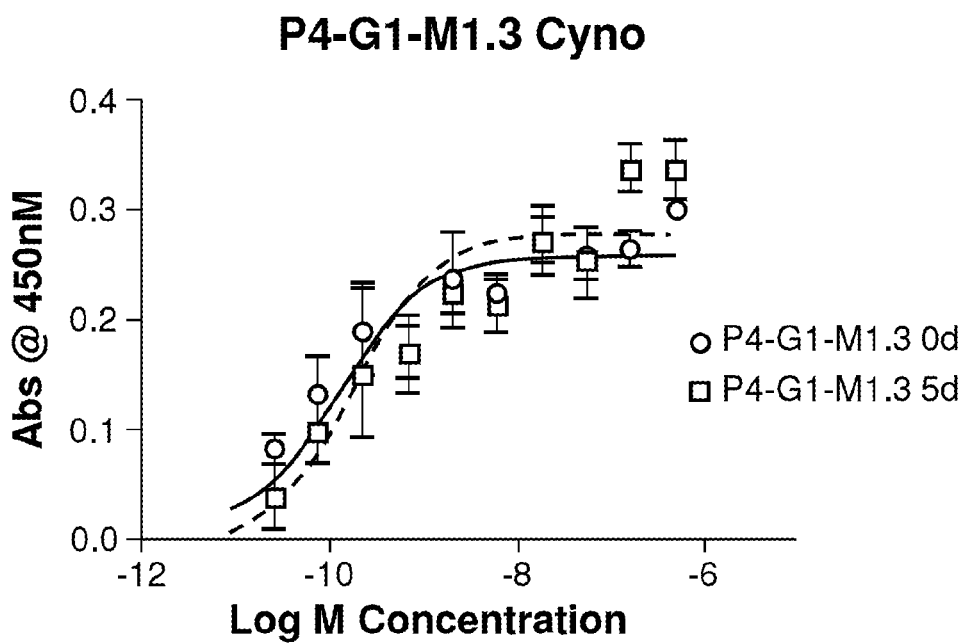
Figure 48E:
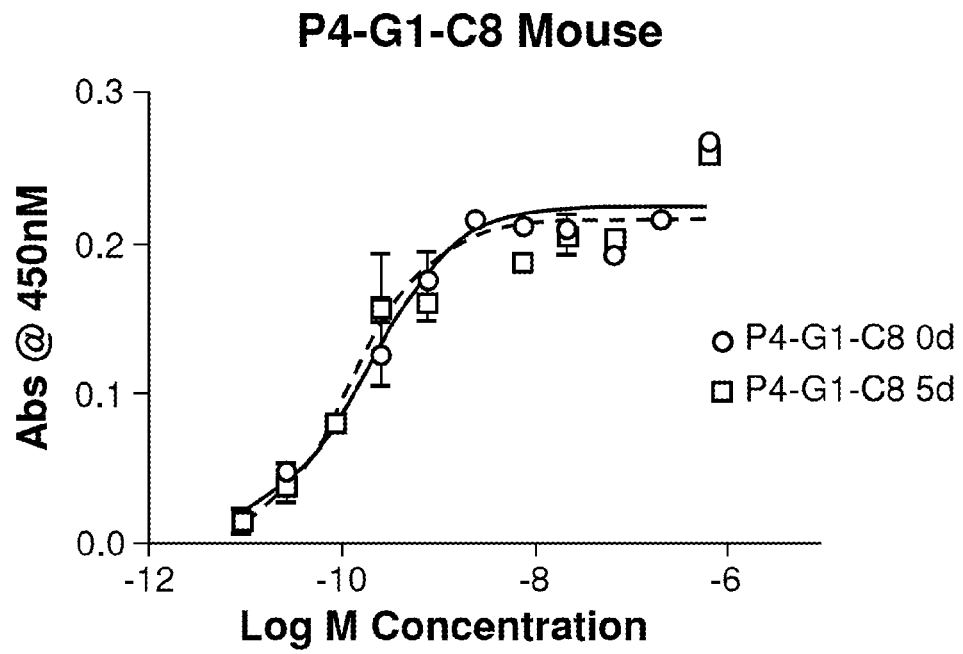
Figure 48F:
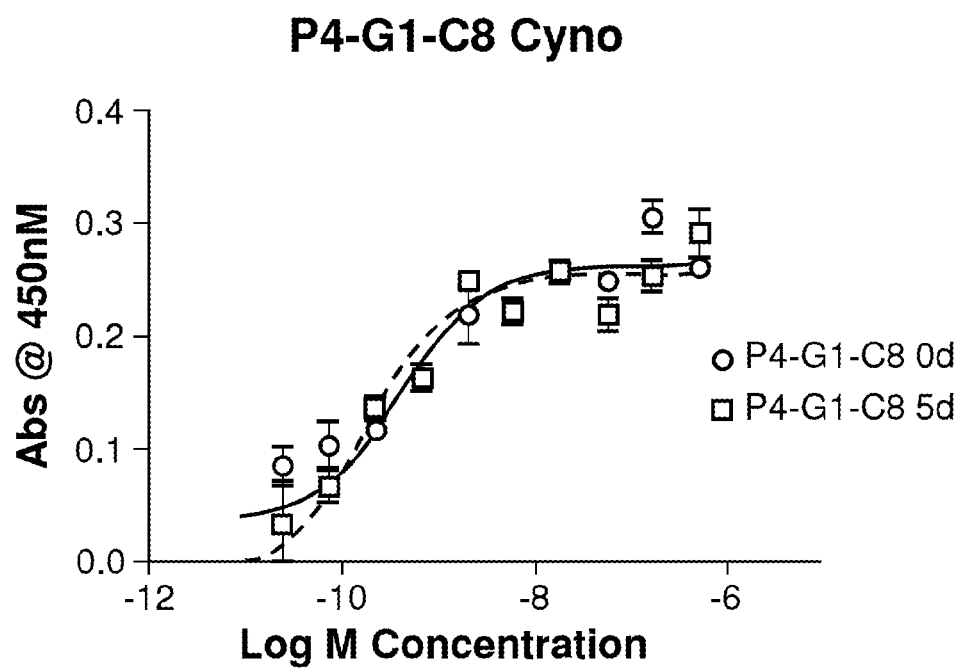
Figure 48G:
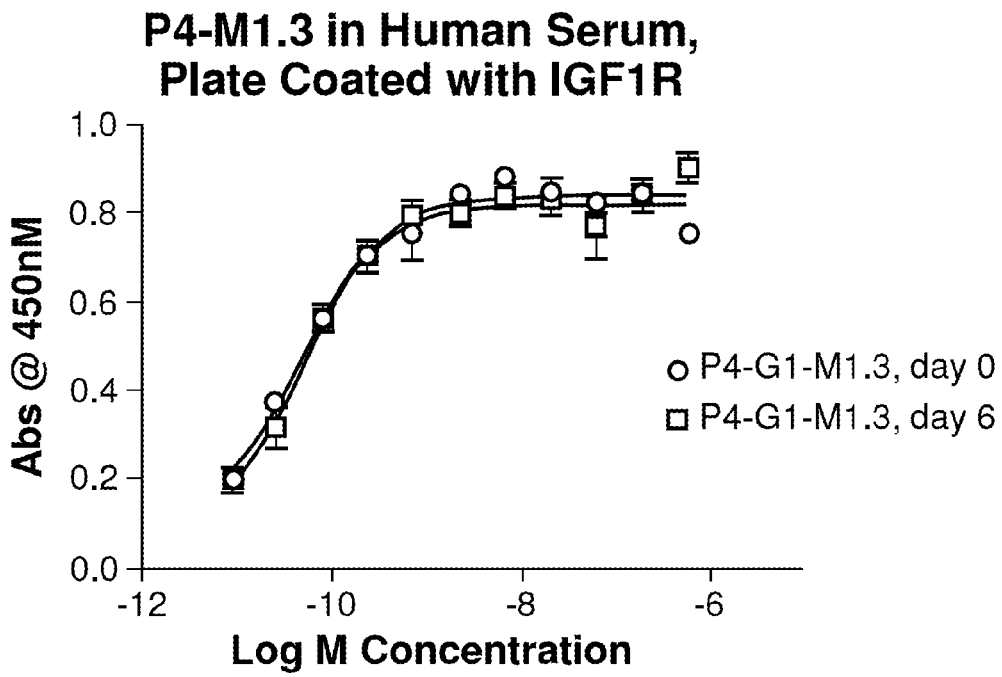
Figure 48H:
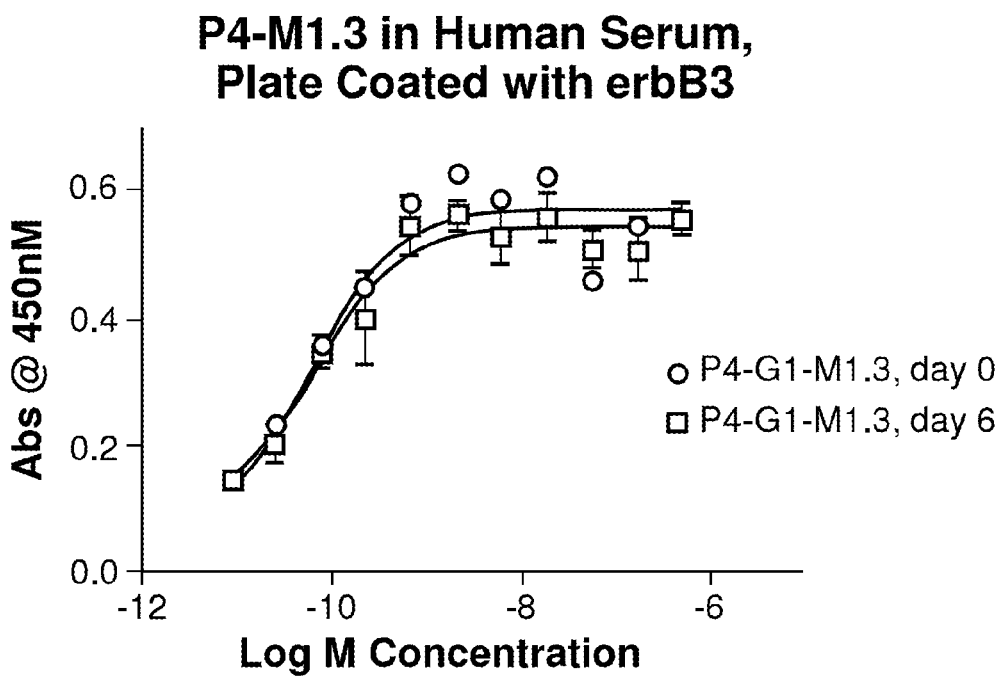
Figure 49A:
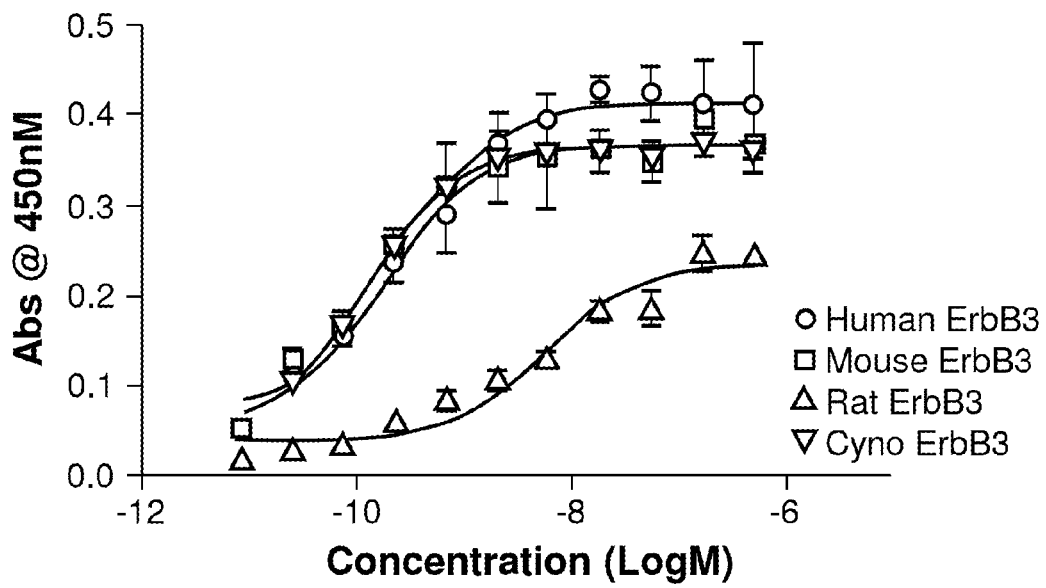
Figure 49B:
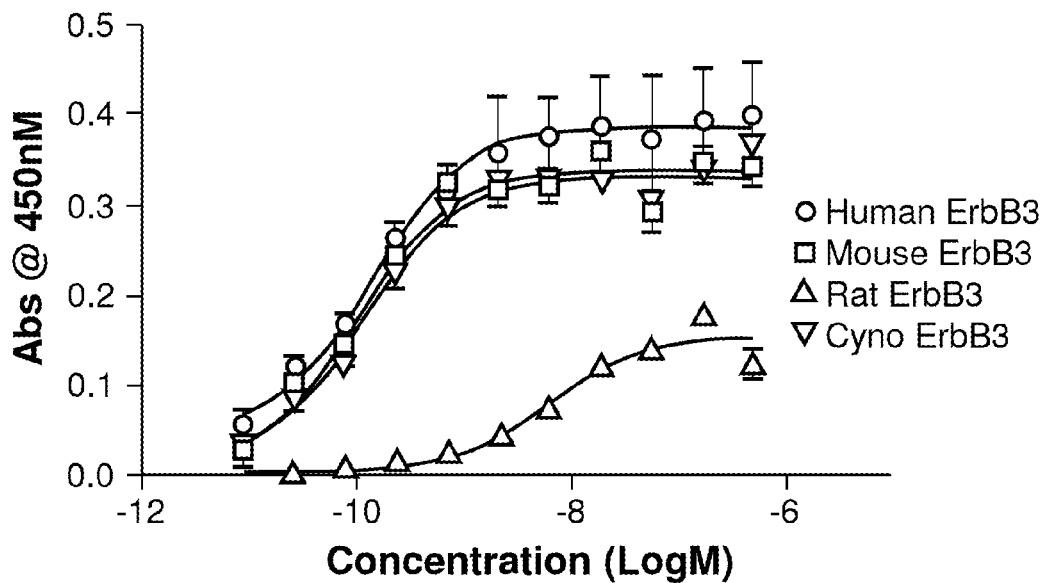
Figure 49C:
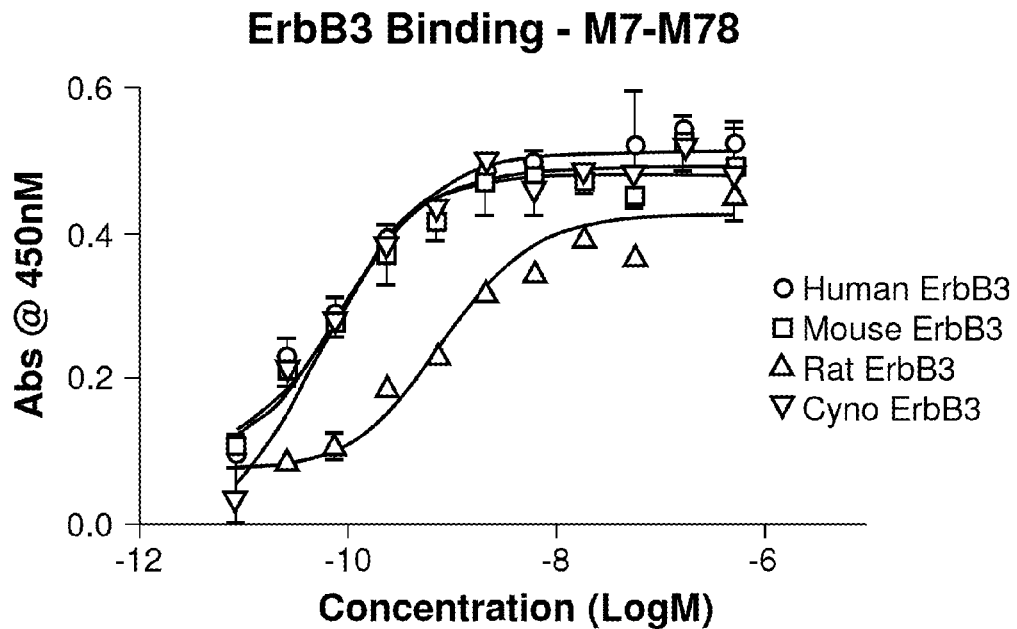
Figure 49D:
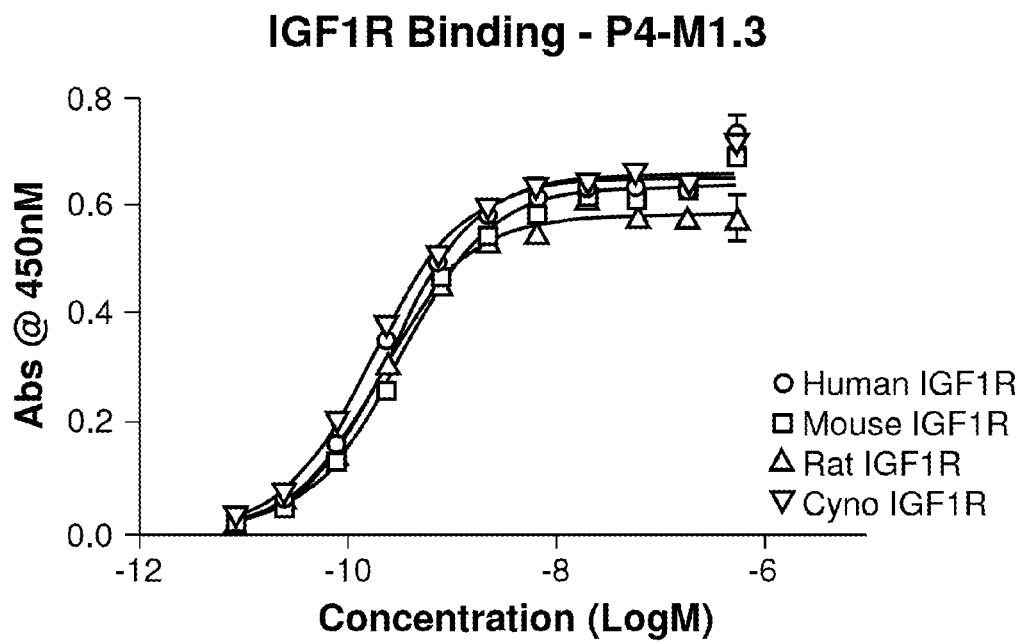
Figure 49E:
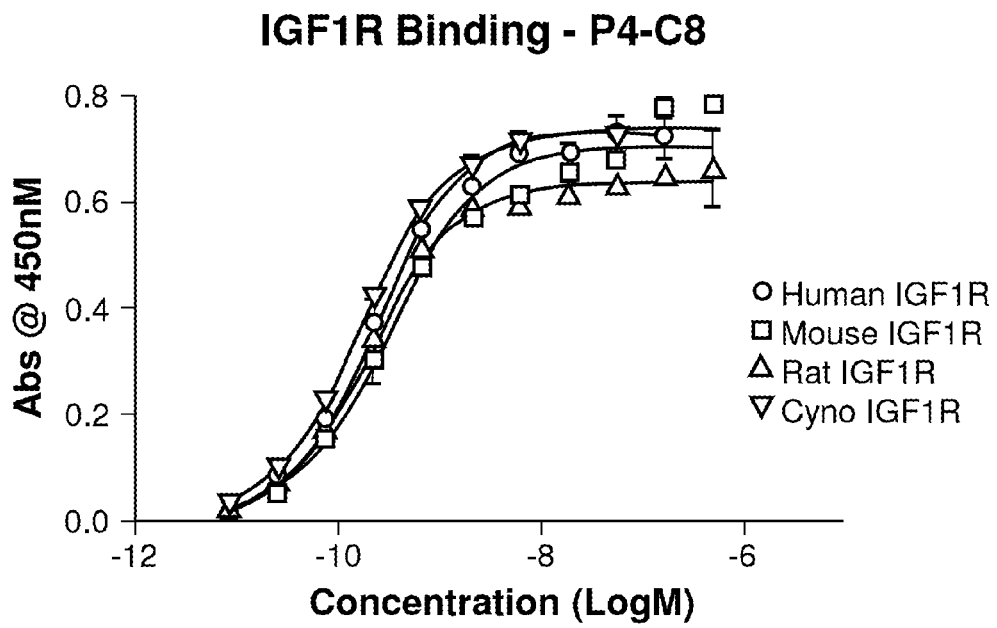
Figure 49F:
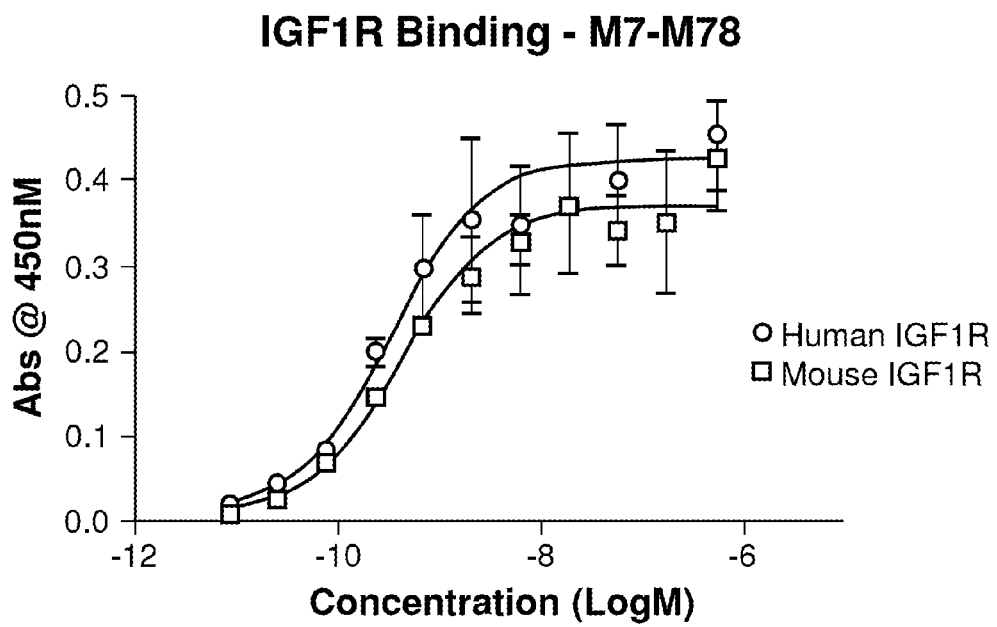

FIG. 47: Western blot showing the protein level of IGF1R, pIGF1R, ErbB3, pErbB3, pAkt and B-Actin in BxPC-3 cells incubated in the absence of ligand (lanes 1-3) or in the presence of IGF1 and heregulin (HRG) (lanes 4-6) and in the absence of a PBA or in the presence of PBA M7-78 or P4-C8.

FIG. 48: A-F show the amount of A-B) M7-G1-M78; C-D) P4-G1-M1.3; E-F) P4-G1-C8 present after 0 or 5 days incubation in mouse or Cynomolgus monkey serum. G-H show the amount of P4G1-M1.3 present after 0 or 6 days in human serum, in plates coated with IGF-1R (G) or ErbB3 (H).

FIG. 49: A-F show the level of binding to A-C) human, mouse, rat and Cynomolgus ErbB3 and D-F) human, mouse, rat and Cynomolgus EGF-1R of PBAs P4-C8 (A, D), P4-M1.3 (B, E) and M7-M78 (C, F). Binding of M7-M78 to rat and Cynomolgus IGF-1R is not provided.

Figure 50A:
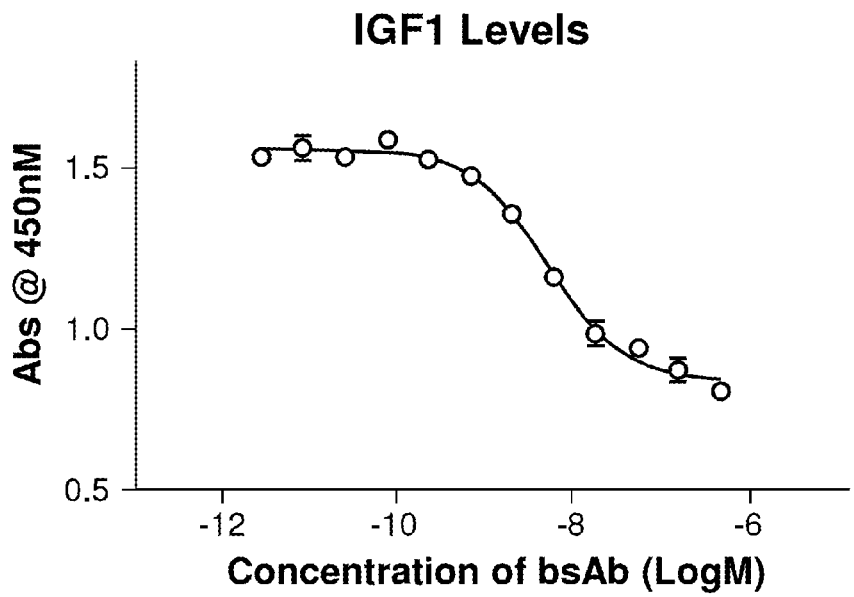
Figure 50B:
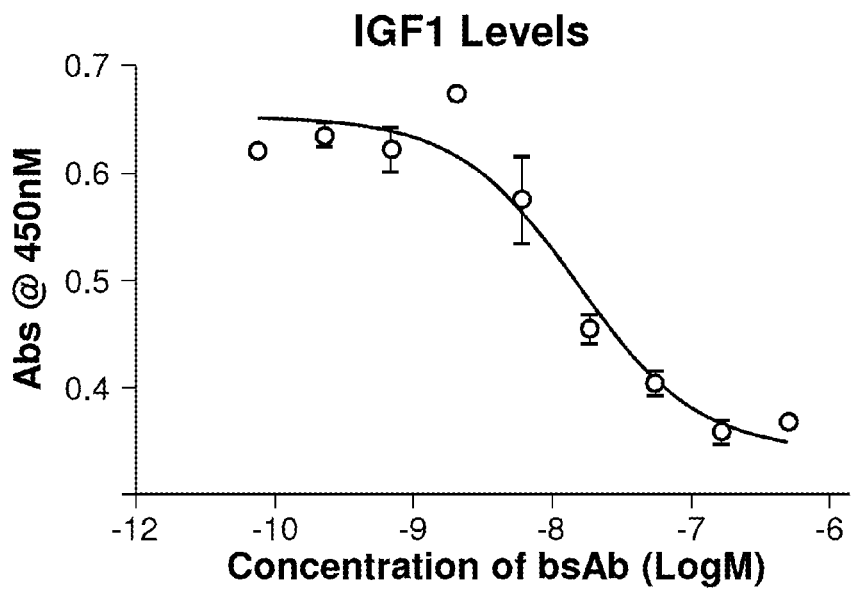
Figure 51A:
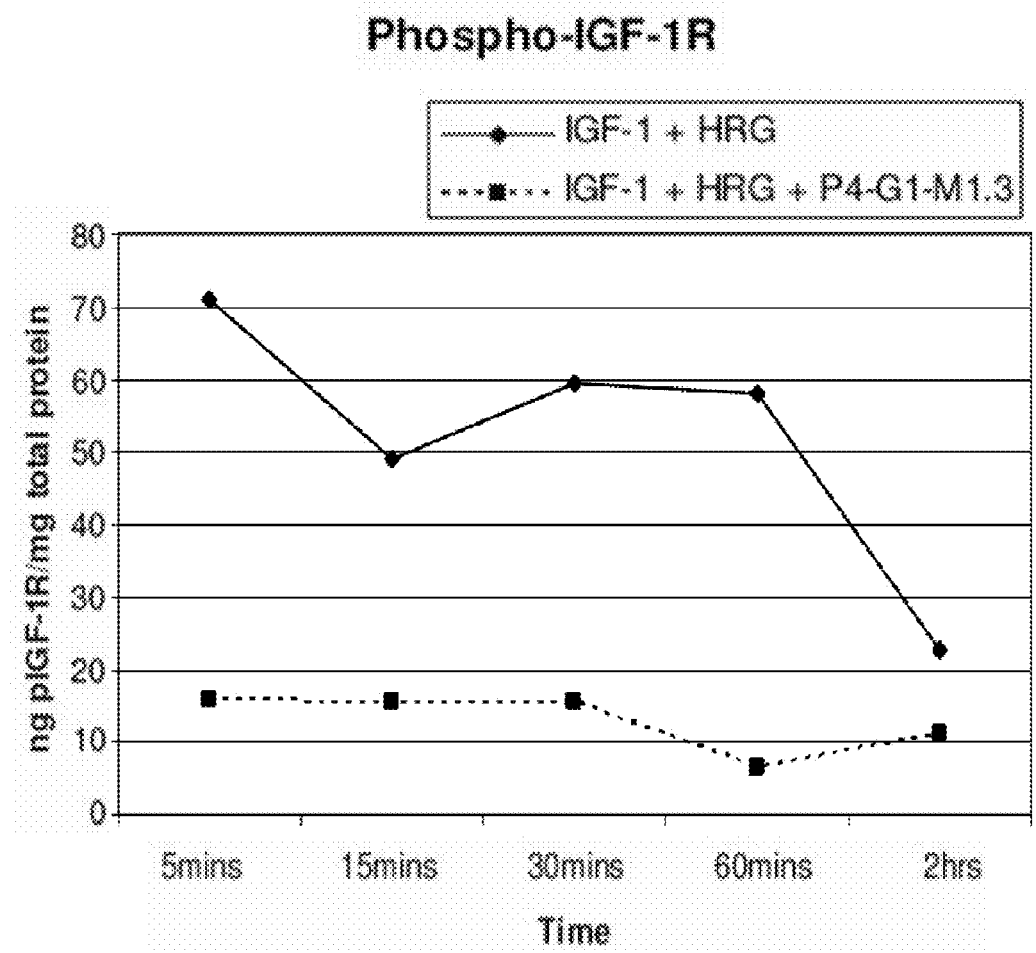
Figure 51B:
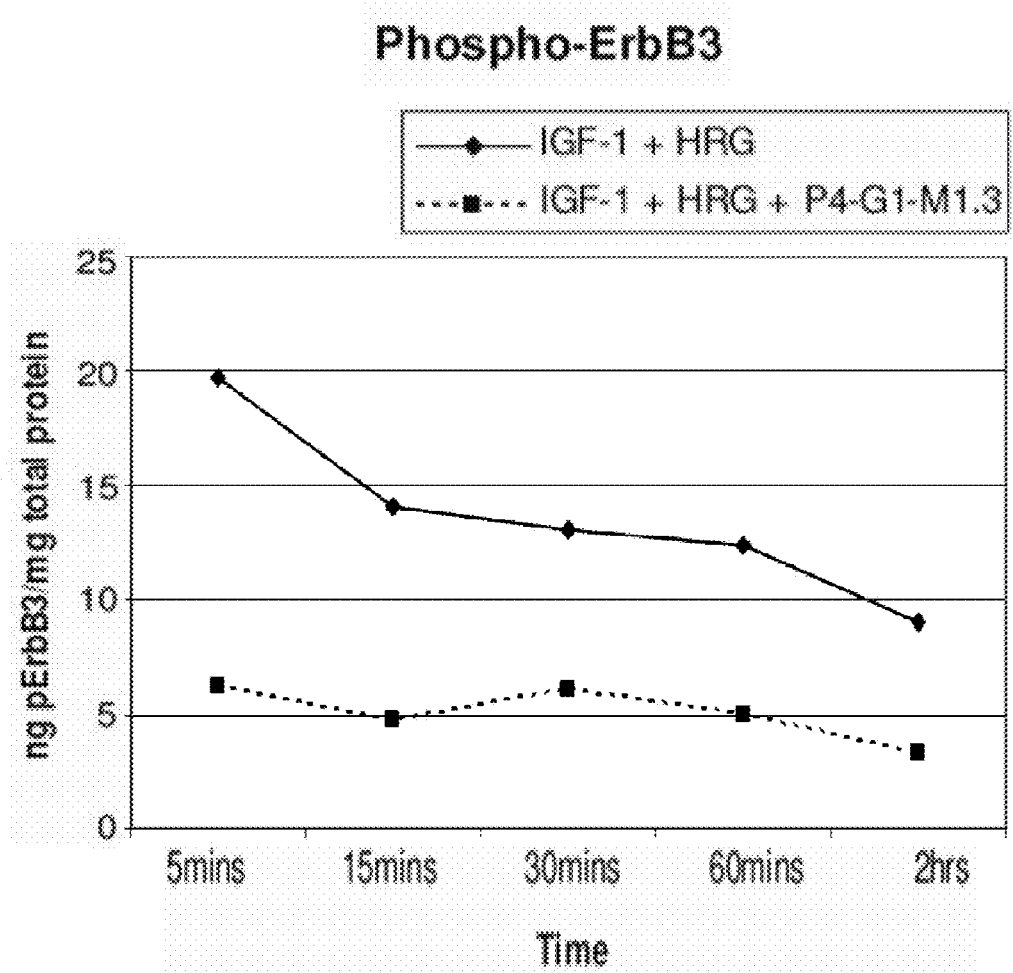
Figure 51C:
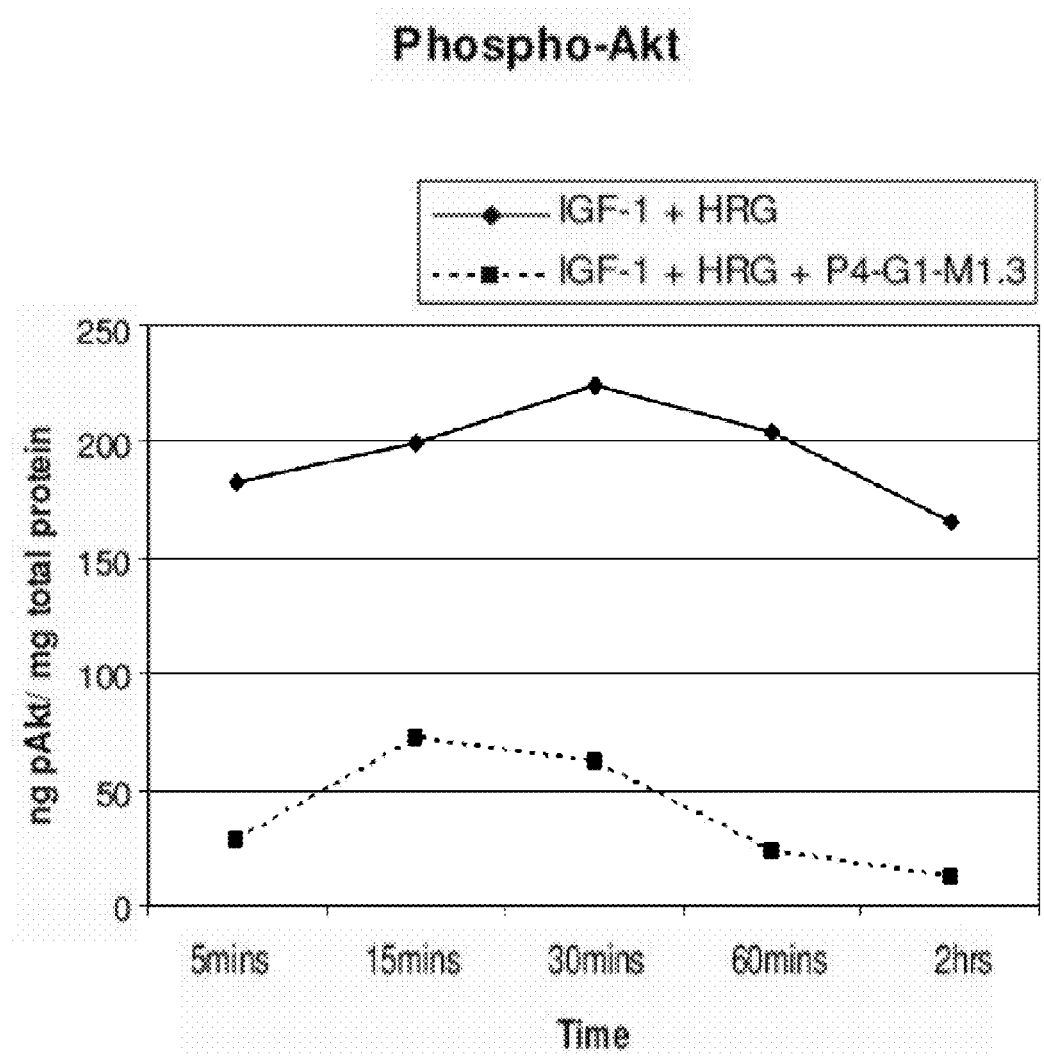
Figure 51D:
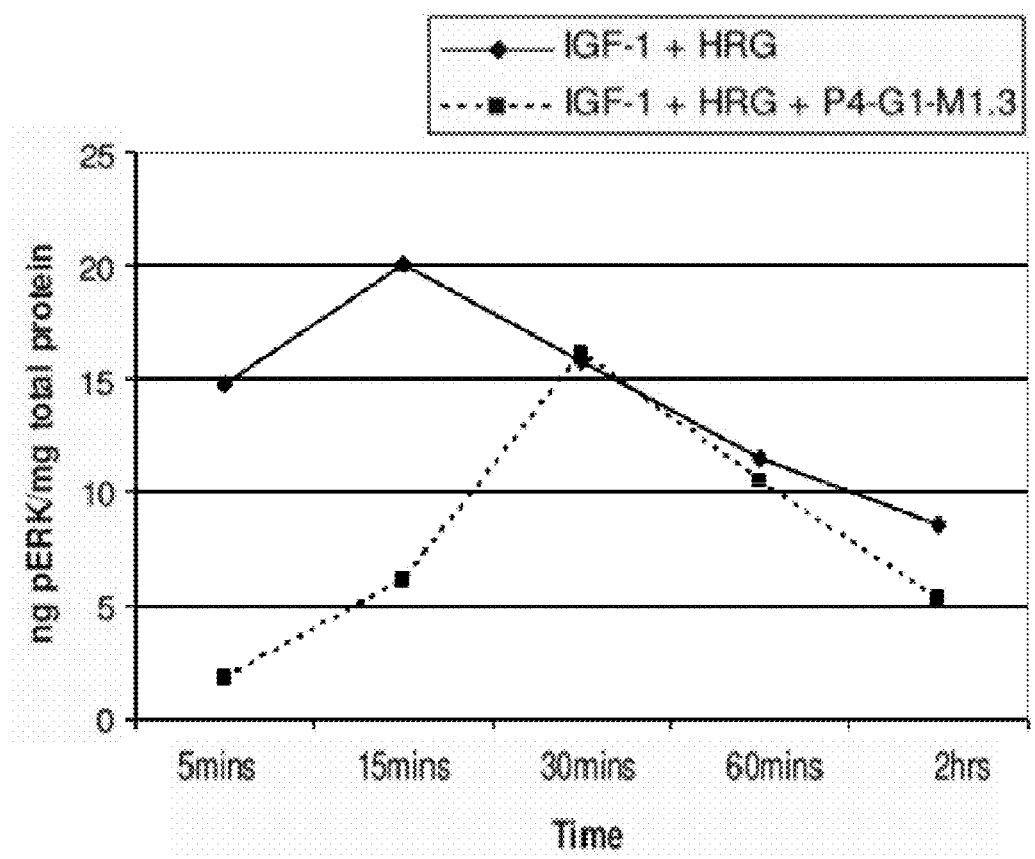
Figure 51E:
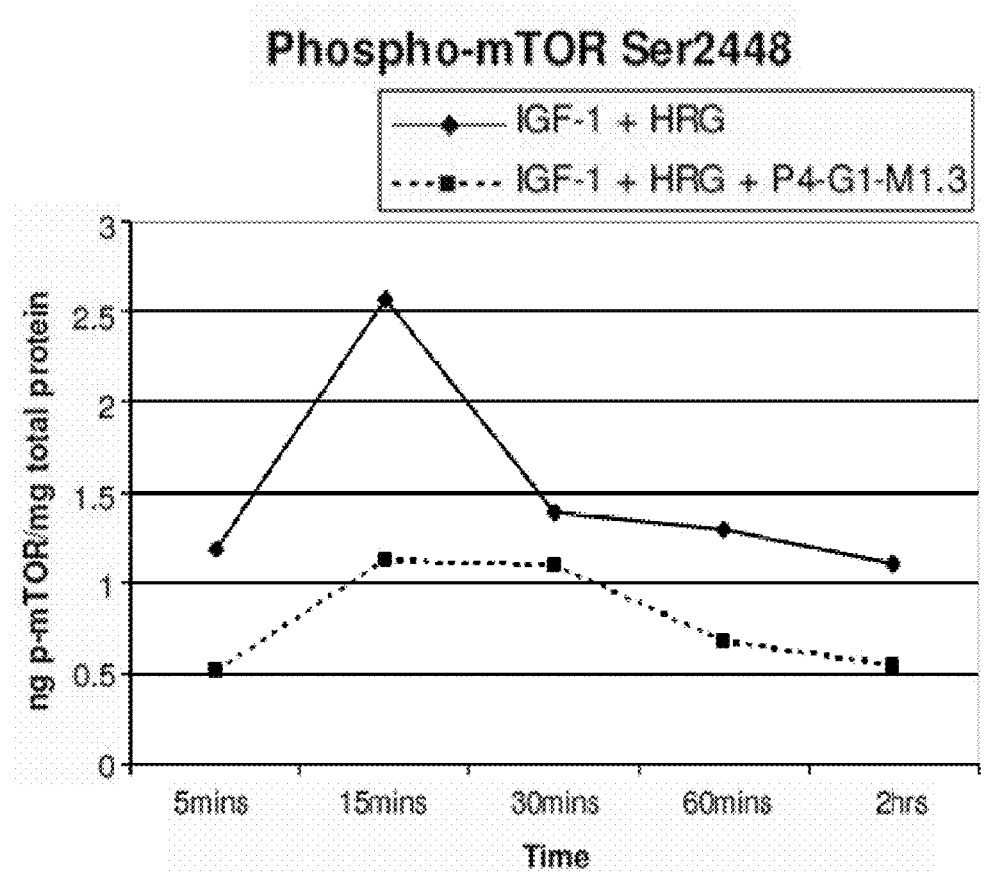
Figure 51F:
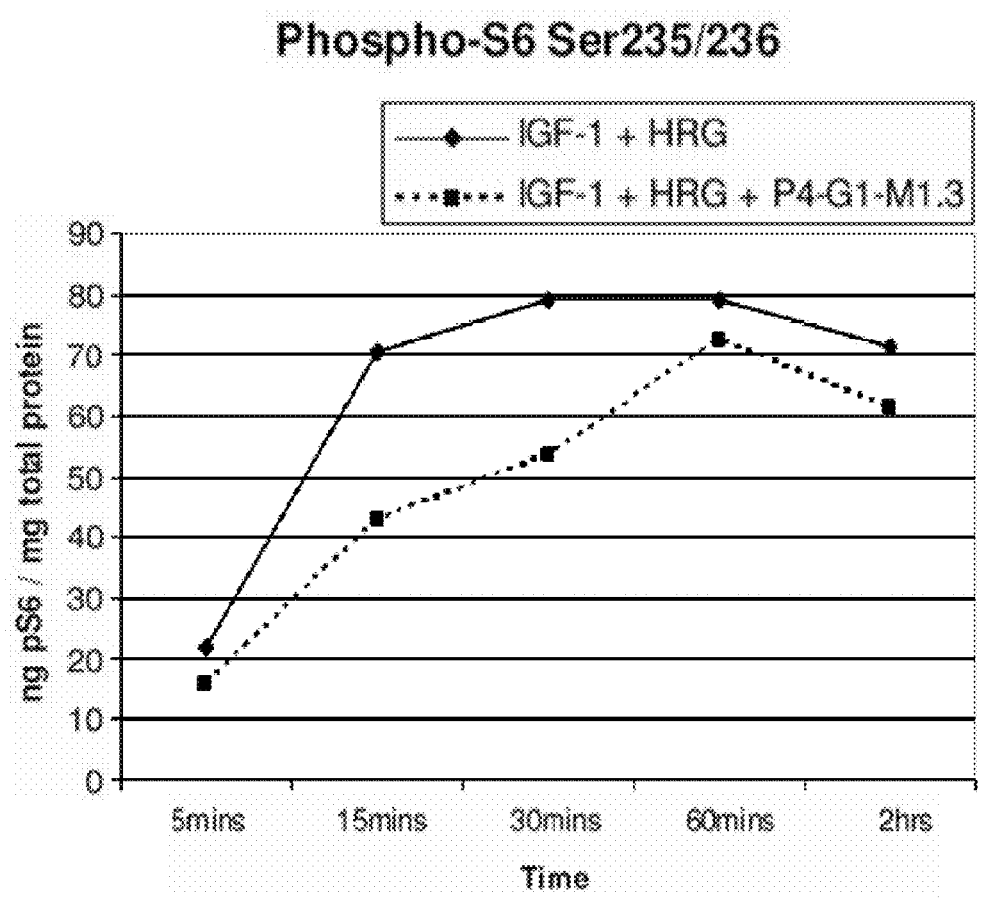

FIG. 50: A-B show the concentration of PBA P4-G1-M1.3 that is necessary to detach A) IGF1 and B) IGF2 from IGF-1R bound to a plate.

FIG. 51: A-F show ng per total mg protein of Phospho-IGF-1R (A), Phospho-ErbB3 (B), Phospho-Akt (C), Phospho-ERK (p44/p42; D), Phospho-mTOR (Ser2448, E) and Phospho-S6 (Ser235/236; 5F) in vitro over time in BxPC-3 cells treated with IGF-1+HRG or IGF-1+HRG+P4-G1-M1.3.

Figure 52:
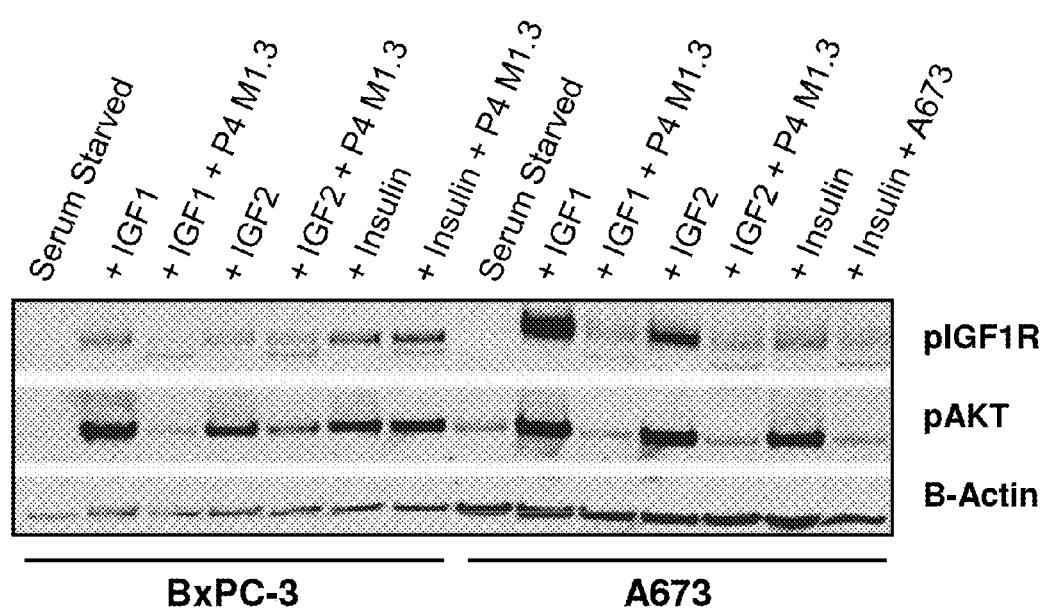

FIG. 52: Levels of pIGF1R, pAKT and B actin in BxPC-3 and A673 cells treated with serum, IGF1, IGF1 and P4M1.3 (P4-G1-M1.3), IGF2, IGF2 and P4M1.3 (P4-G1-M1.3), insulin, and insulin and P4M1.3 (P4-G1-M1.3).

Figure 53A:
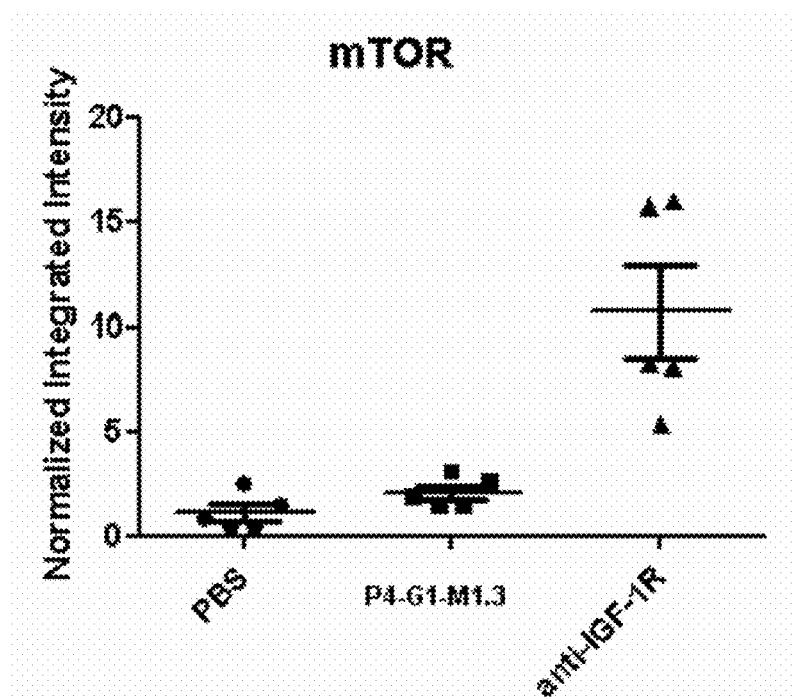
Figure 53B:
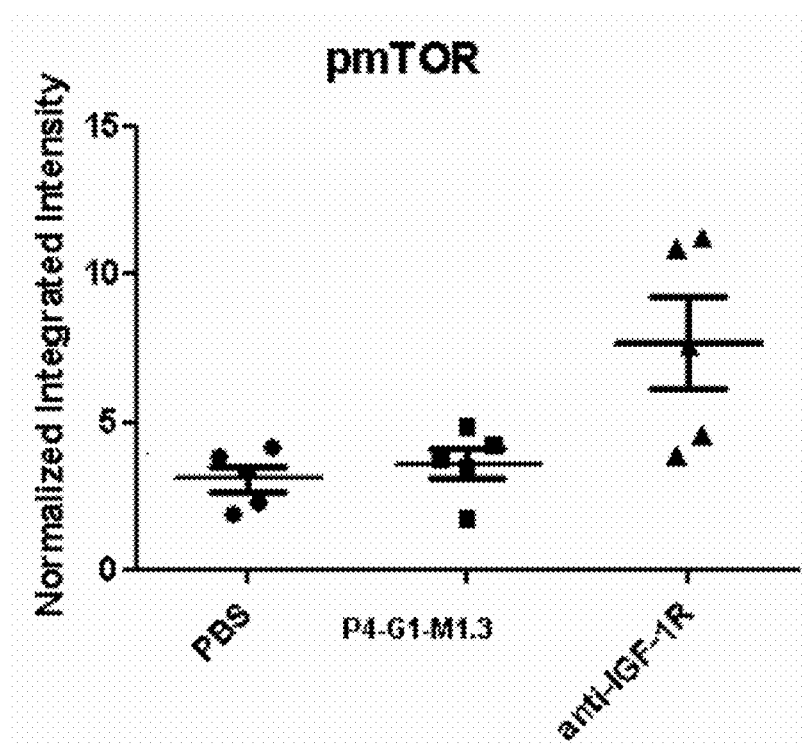
Figure 54D:
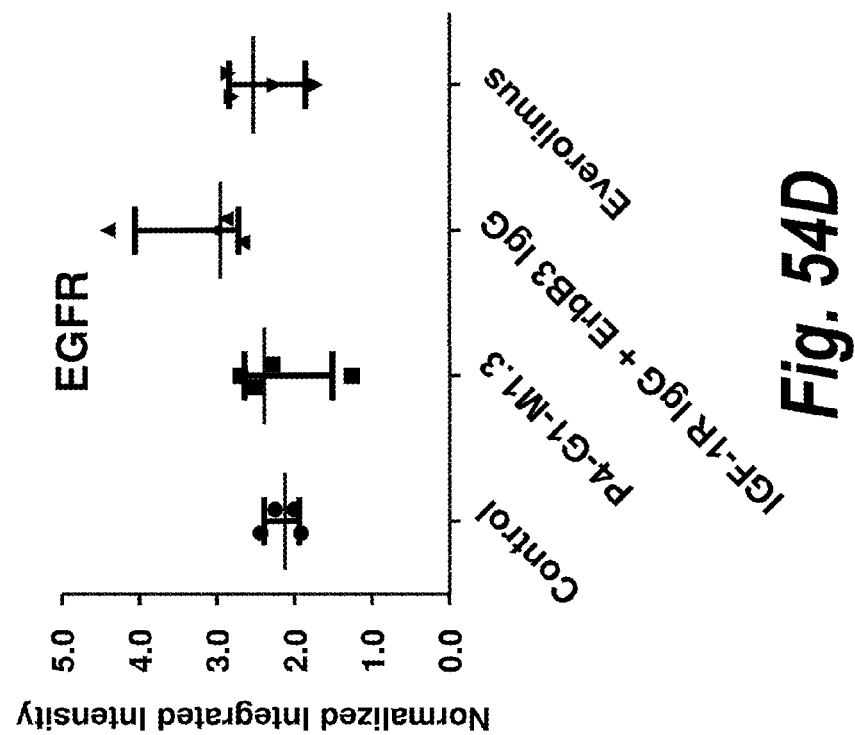
Figure 54C:
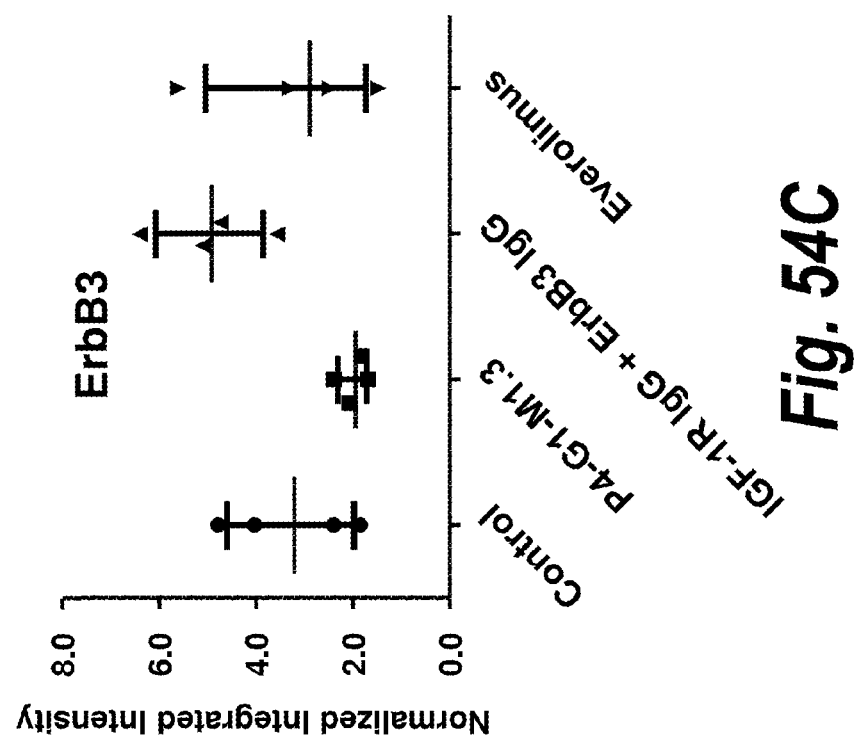
Figure 54F:
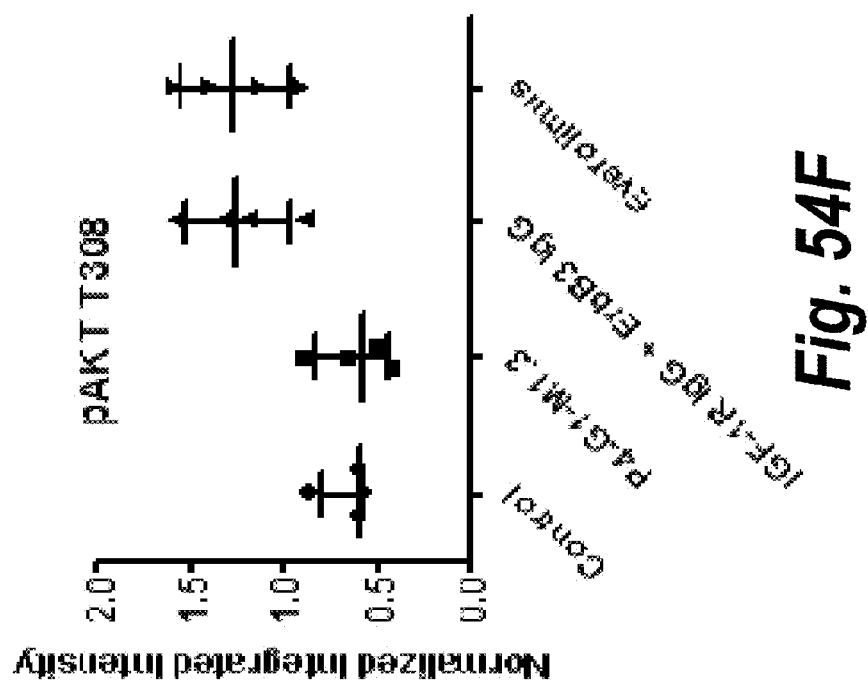
Figure 54E:
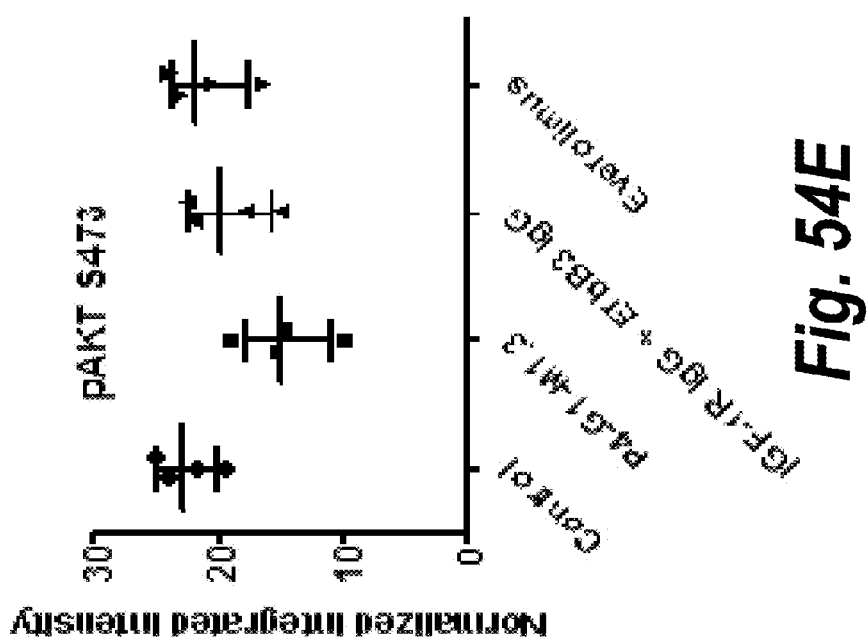
Figure 54G:
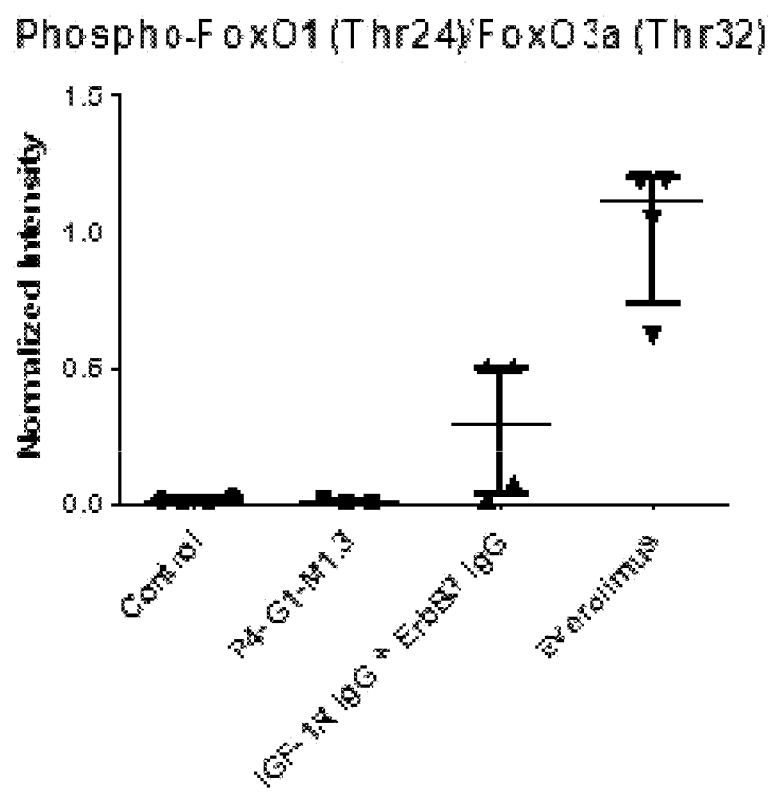
Figure 54I:
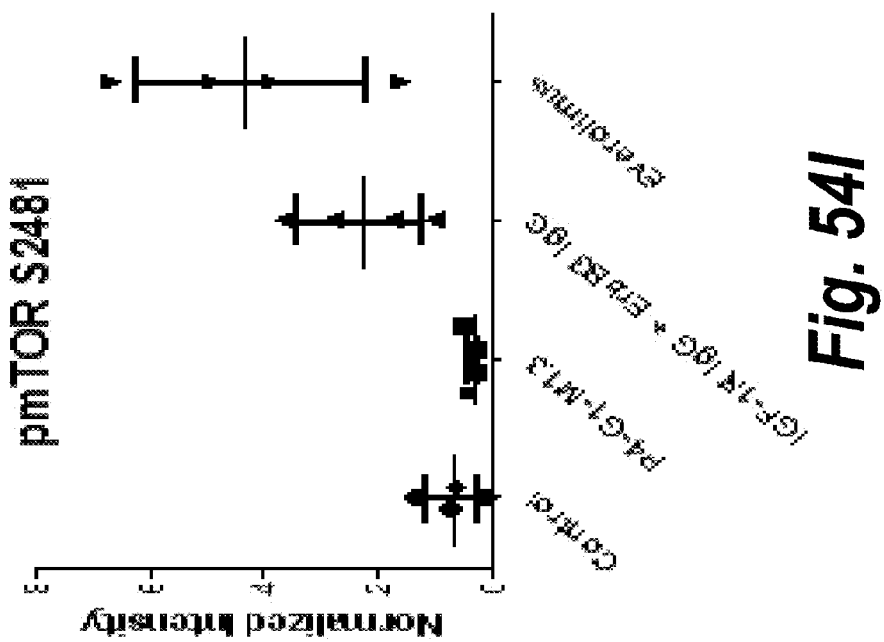
Figure 54H:
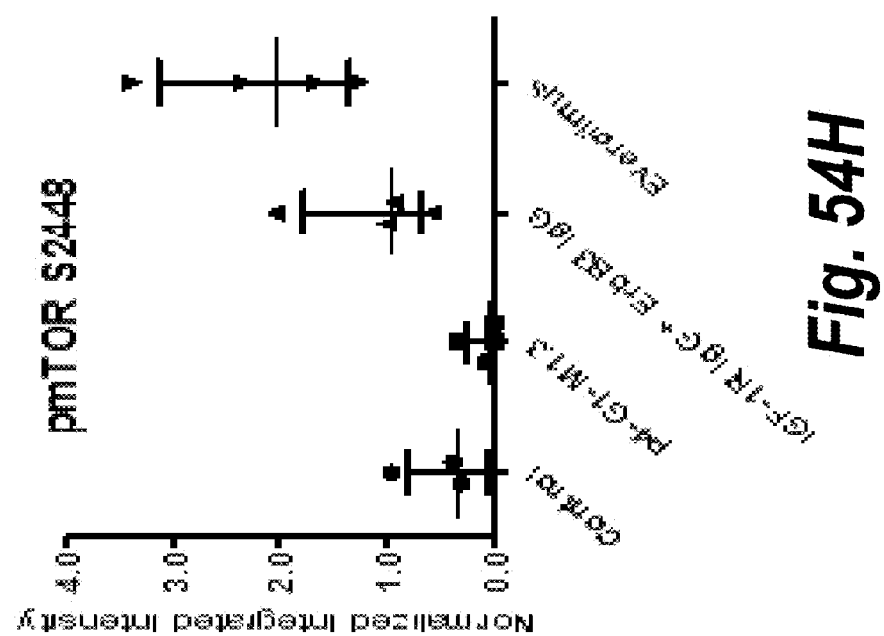
Figure 54K:
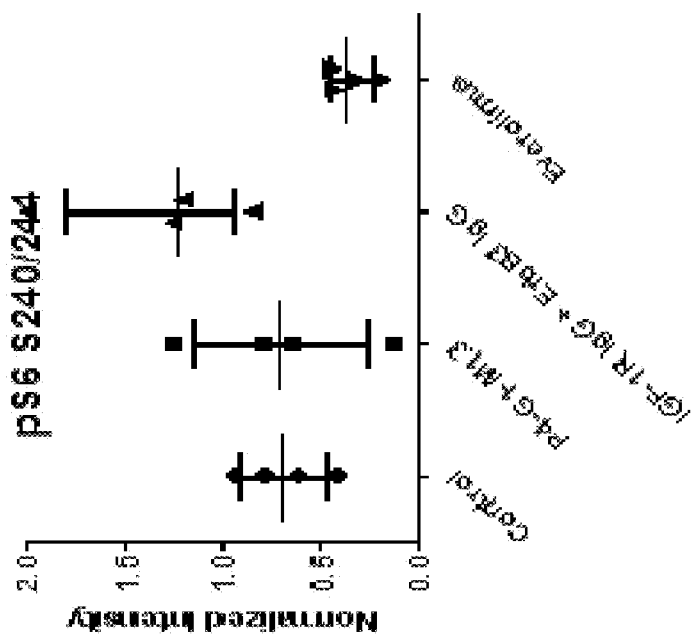
Figure 54J:
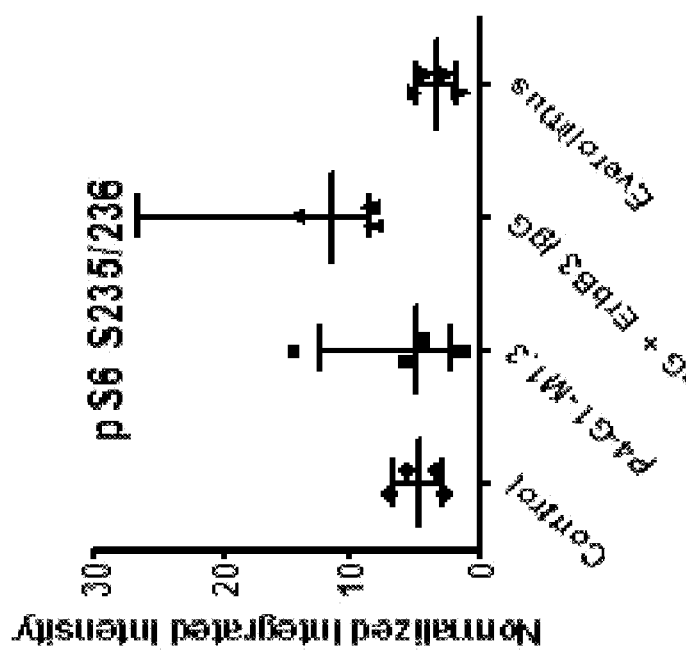
Figures 55A, 55B:
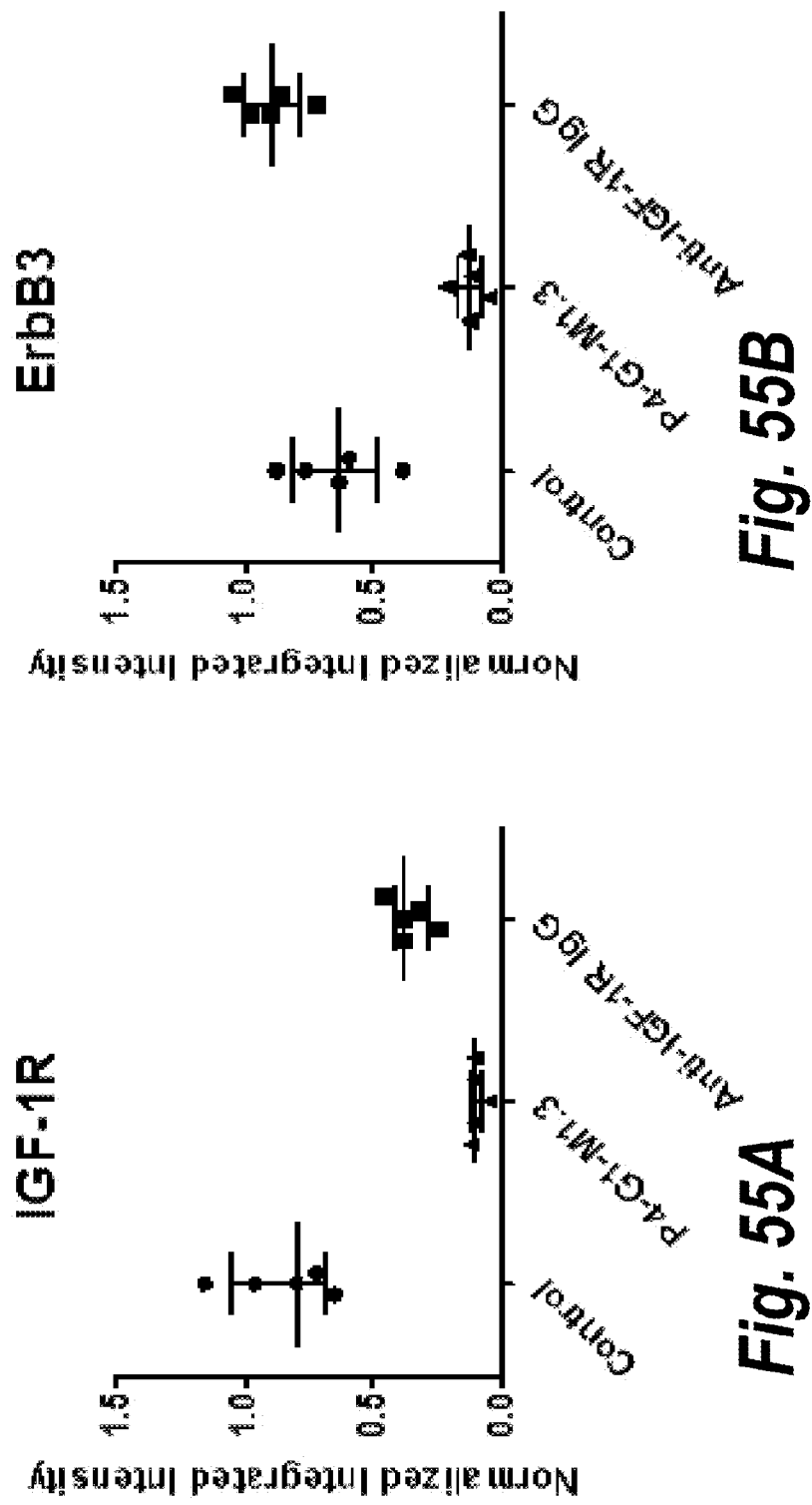
Figure 55C:
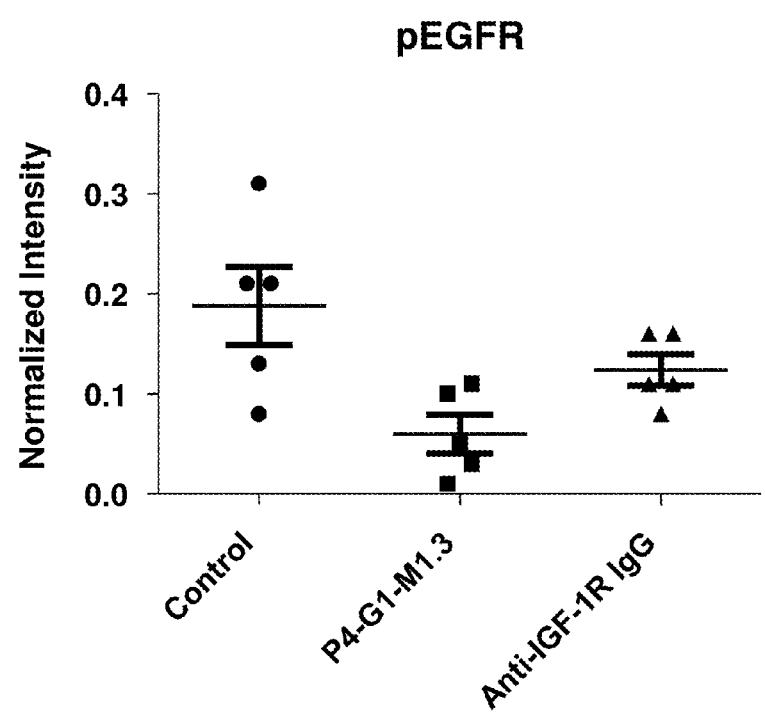

FIG. 53: A-B show the level of mTOR (A) and phospho-mTOR ("pmTOR") in end of study BxPC-3 tumors of mice in which one of PBS, P4-G1-M1.3 or anti-IGF-1R Ab# A was injected.

FIGS. 54A-K: show the level of IGF-1R (A) and insulin receptor (B), ErbB3(C) and EGFR (D), AKT phosphorylated on residue S473 ("pAKT S473") (E) and T308 ("pAKT T308") (F), phospho-Fox01 and Fox03a "Phospho-Fox01 (Thr24)/Fox03a (Thr32)"), mTOR phosphorylated on residue S2448 (H) and S2481 (I), and S6 phosphorylated on residue S235/236 (J) and S 240/244 (K) "pS6 S235/236" and "pS6 S240/244")) in end of study Caki-1 tumors of mice in which one of PBS, P4-G1-M1.3, anti-IGF-1R Ab# A+anti-ErbB3 IgG, and the mTOR inhibitor everolimus was injected.

FIGS. 55A-E: show the level of IGF-1R(A) and ErbB3 (B), phospho-EGFR ("pEGFR")(C), and phospho-mTOR ("pmTOR S2448") (D) and phospho-S6 ("pS6 S235/236") (E) in end of study BxPC-3 tumors of mice in which one of PBS, P4-G1-M1.3, and anti-IGF-1R Ab# A was injected.

Figure 56B:
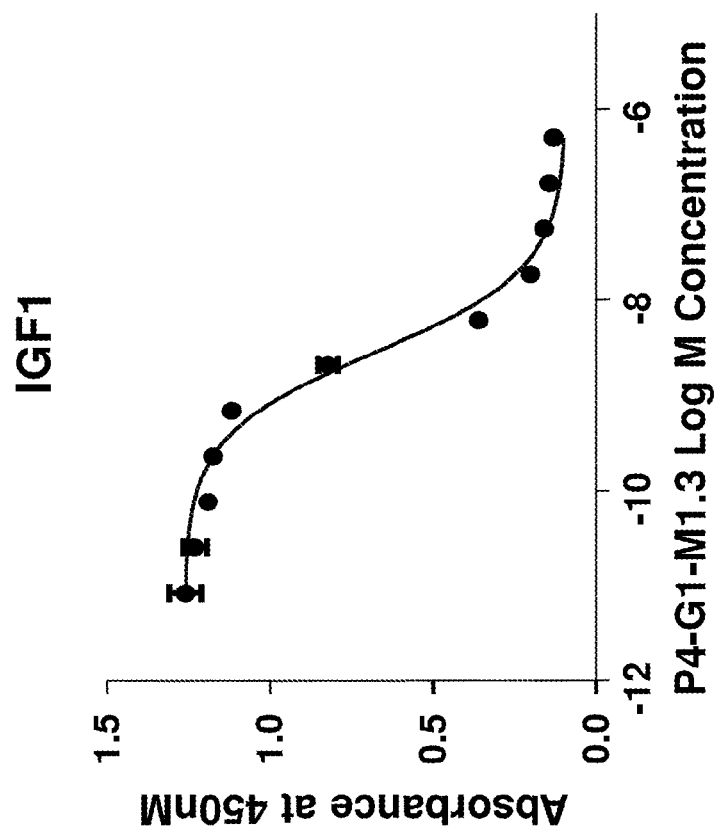
Figure 56A:
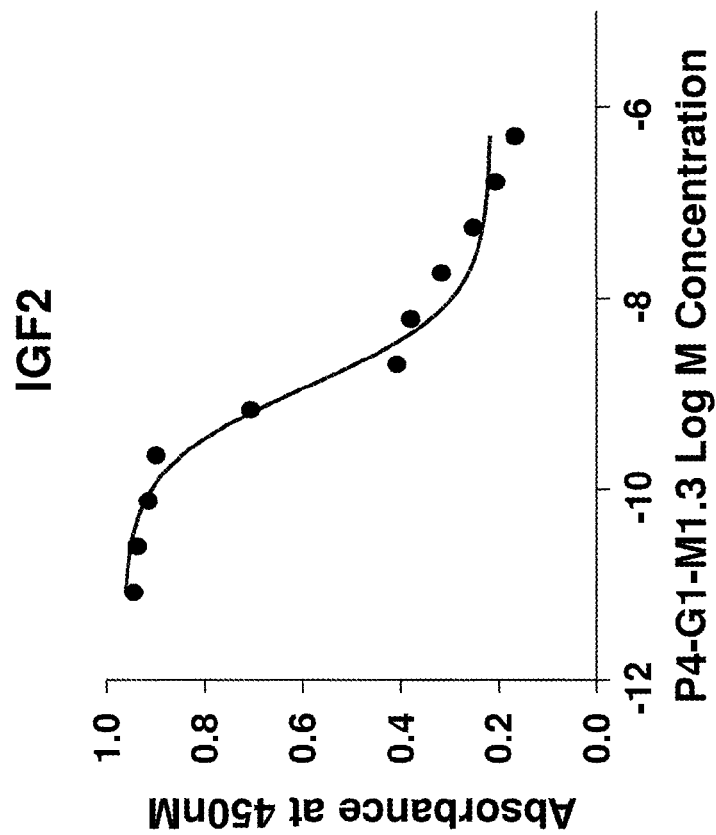
Figure 57A:
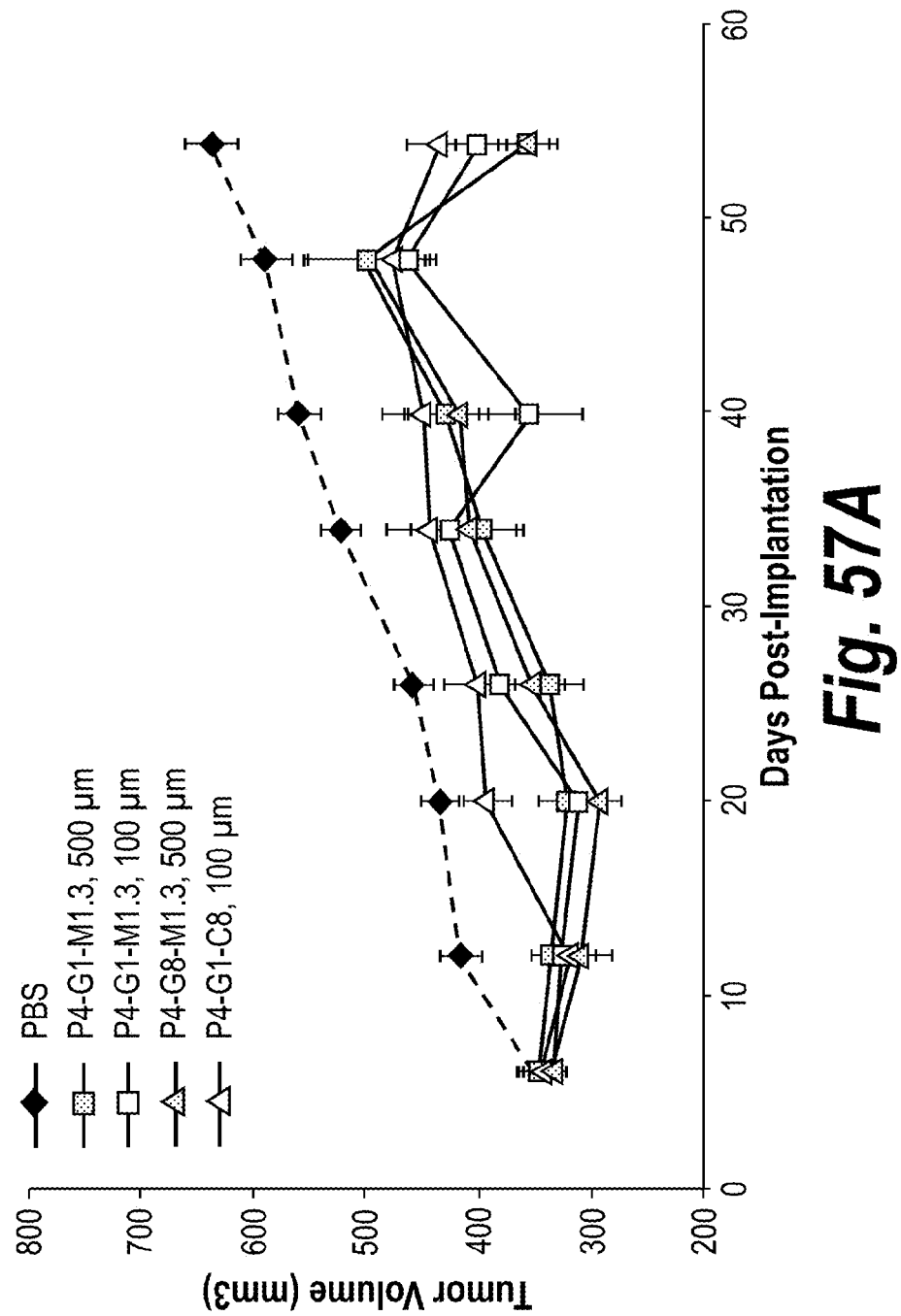
Figure 57B:
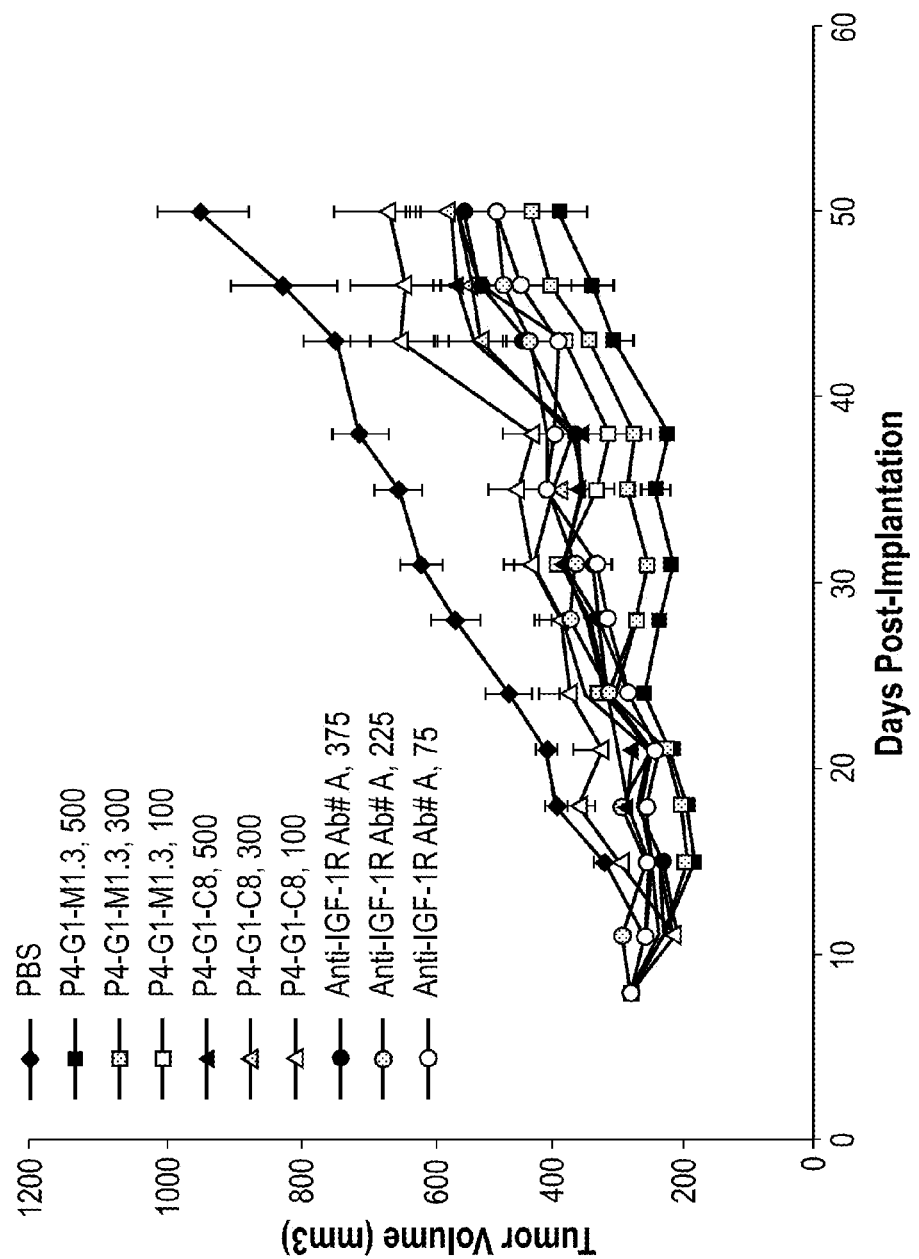
Figure 57C:
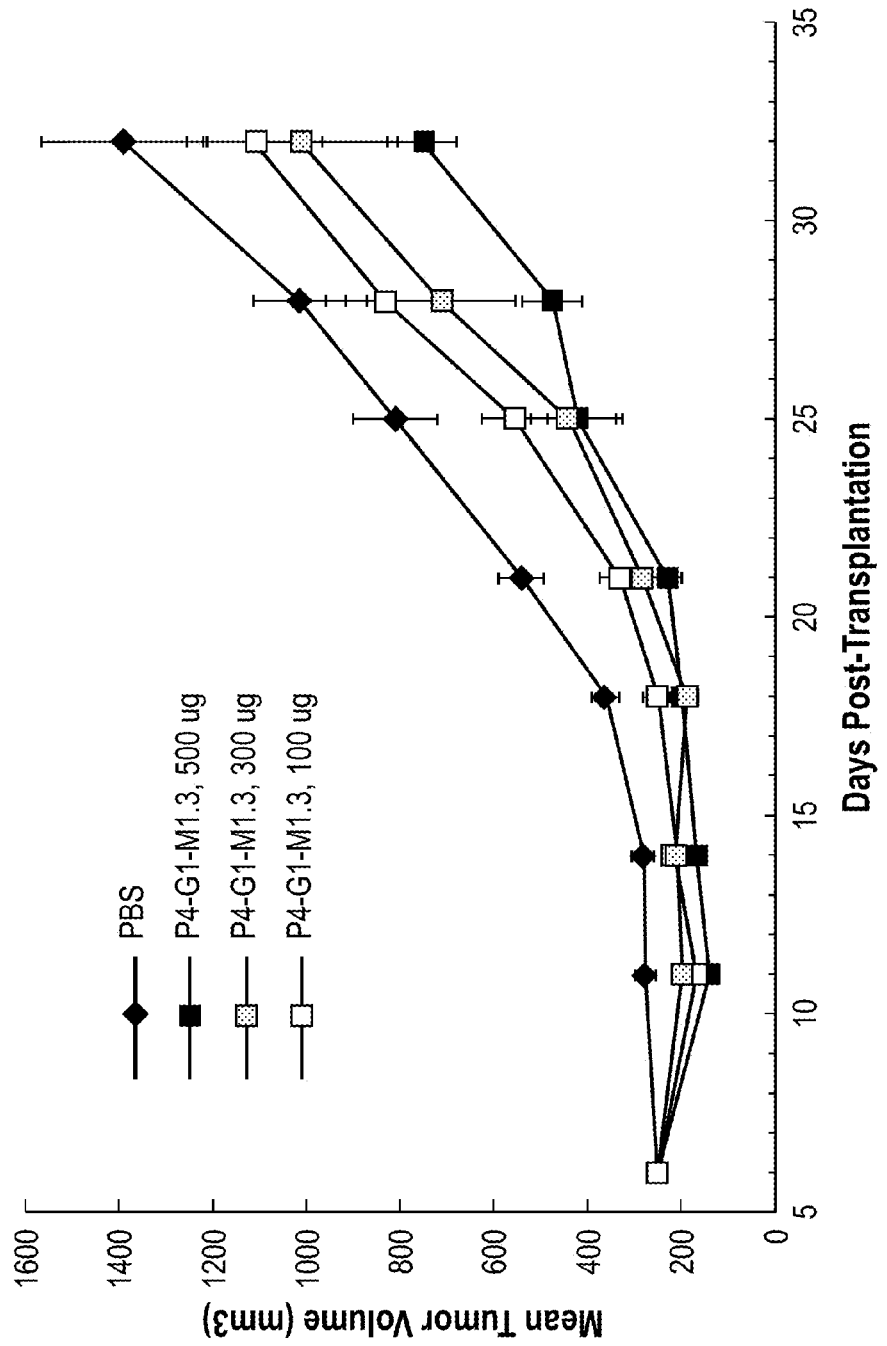
Figure 57D:
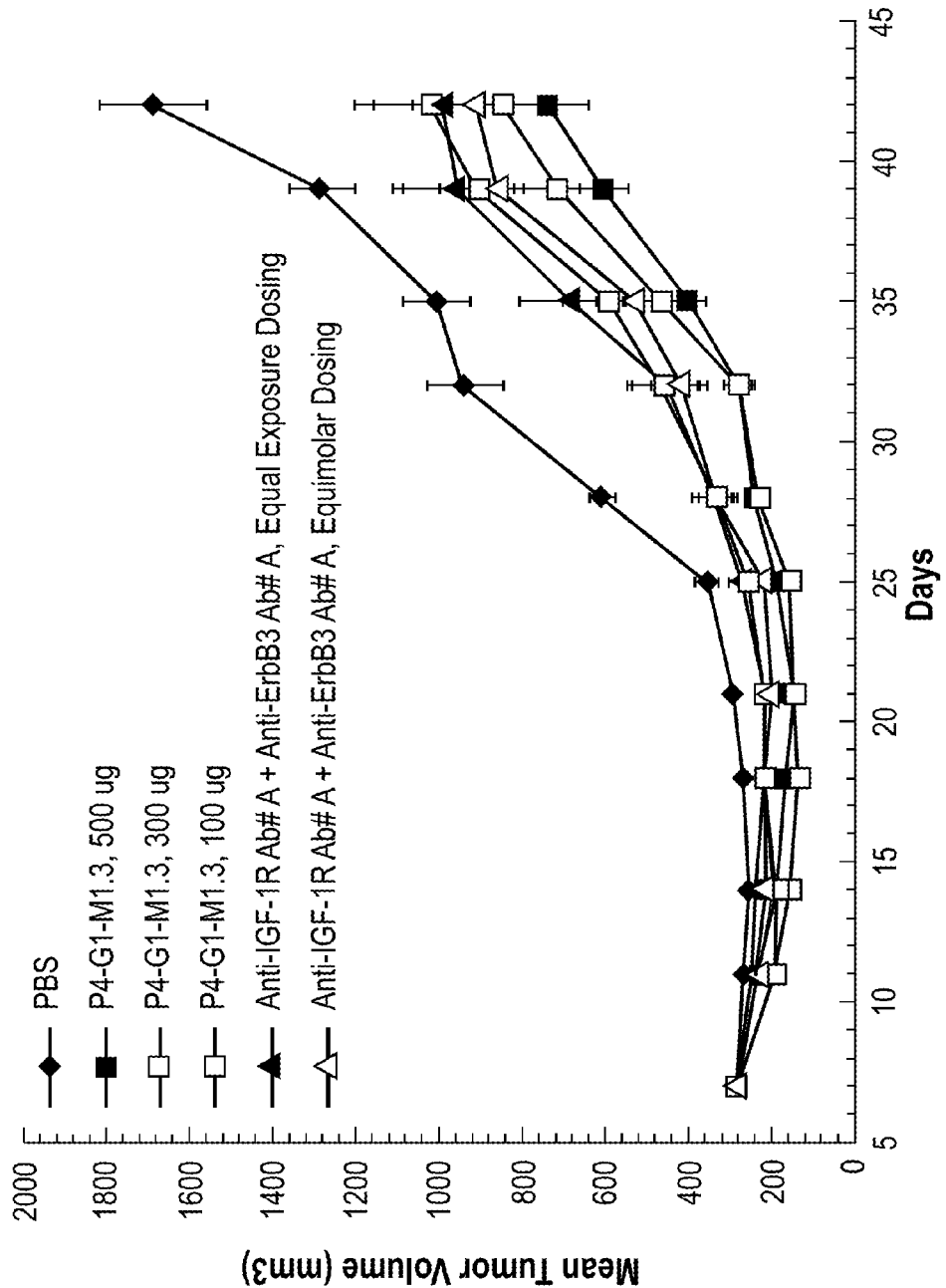

FIGS. 56A-B: shows the level of IGF-1 ("IGF1", left panel) (A) and IGF-2 ("IGF2", right panel) (B) in an ELISA assay wherein plates were coated with IGF-1R-His and a serial dilution of P4-G1-M1.3 was added to the wells.

FIG. 57: A-D shows the mean tumor volume over time in a DU145 (A), BxPC-3 (B), SK-ES-1 (C), and Caki-1 (D) xenograft model. Mice were injected with one of PBS, 500 µg P4-G1-M1.3, 100 µg P4-G1-M1.3, 500 µg P4-G1-C8, or 100 µg P4-G1-C8 (A); PBS, 500 µg P4-G1-M1.3, 300 µg P4-G1-M1.3, 100 µg P4-G1-M1.3, 500 µg P4-G1-C8, 300 µg P4-G1-C8, 100 µg P4-G1-C8, 375 µg anti-IGF-1R Ab# A (ganitumab; SEQ ID NO:327+SEQ ID NO:328), 225 µg anti-IGF-1R Ab# A (ganitumab; SEQ ID NO:327+SEQ ID NO:328), or 75 µg anti-IGF-1R Ab# A (ganitumab; SEQ ID NO:327+SEQ ID NO:328) (B); PBS, 500 µg P4-G1-M1.3, 300 µg P4-G1-M1.3, or 100 µg P4-G1-M1.3 (C); or PBS, 500 µg P4-G1-M1.3, 300 µg P4-G1-M1.3, 100 µg P4-G1-M1.3, anti-IGF-1R+anti-ErbB3 at equal exposure dosing, or anti-IGF-1R+anti-ErbB3 at equimolar dosing (D).

Figure 58:
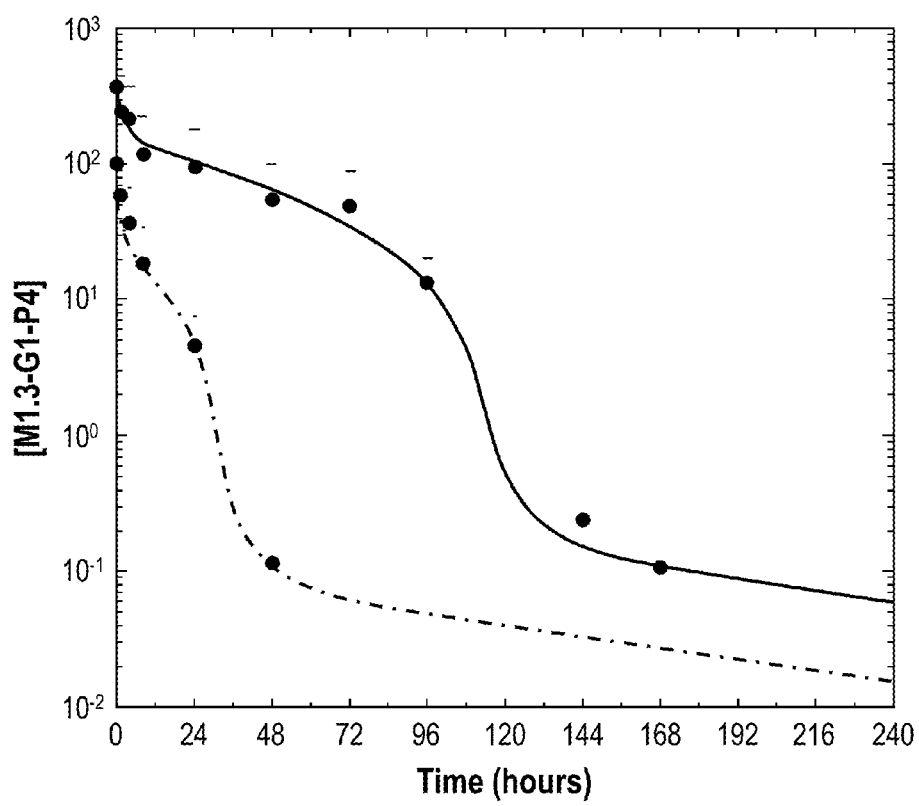

FIG. 58 shows the fitting of the target mediated drug disposition model to experimental data from mouse blood from mice injected with M1.3-G1-P4. The solid line is the fit of a mouse given a 500 µg dose and the dotted line is the fit of a mouse given a 100 µg dose.

BRIEF DESCRIPTION OF THE SEQUENCES

The amino acid ("aa") sequences referred to herein and listed in the sequence listing are identified below.
SEQ ID NO:1 is an aa consensus sequence derived from exemplary IGF-1R VH sequences.
SEQ ID NO:2 is an aa consensus sequence derived from exemplary IGF-1R VL sequences.
SEQ ID NO:3 is an aa consensus sequence derived from exemplary IGF-1R VL sequences, which excludes the VL sequence of the IGF-1R binding site of 16F.
SEQ ID NO:4 is an aa consensus sequence derived from exemplary ErbB3 VH sequences.
SEQ ID NO:5 is an aa consensus sequence derived from exemplary ErbB3 VH sequences, which excludes the VH of the ErbB3 binding site of 16F.
SEQ ID NO:6 is an aa consensus sequence derived from exemplary ErbB3 VL sequences.
SEQ ID NO:7 is an aa consensus sequence derived from exemplary ErbB3 VL sequences, which excludes the VL sequence of the ErbB3 binding site of 16F.
SEQ ID NOs:8-31 are the IGF-1R VH aa sequences of FIG. 1.
SEQ ID NOs:32-133 are the IGF-1R VL aa sequences of FIG. 2.
SEQ ID NOs:134-165 are the ErbB3 VH aa sequences of FIG. 3.
SEQ ID NOs:166-200 are the ErbB3 VL aa sequences of FIG. 4.
SEQ ID NOs:201-256 are the nucleotide sequence (odd numbers) and aa sequences (even numbers) of the mature light and heavy chains of anti-IGF-1R/anti-ErbB3 IgG1(scFv)$_2$ provided in FIG. 5A, the sequence ID numbers of which are as follows. Kappa light chains: SF (SEQ ID NOs:201 and 202); P4 (SEQ ID NOs:203 and 204); M78 (SEQ ID NOs:205 and 206); and M57 (SEQ ID NOs:207 and 208). Heavy chain scFv fusions (hybrids): SF-G1-C8 (i.e., 16F; SEQ ID NOs:209 and 210); SF-G1-P1 (SEQ ID NOs:211 and 212); SF-G1-M1.3 (SEQ ID NOs:213 and 214); SF-G1-M27 (SEQ ID NOs:215 and 216); SF-G1-P6 (SEQ ID NOs:217 and 218); SF-G1-B69 (SEQ ID NOs:219 and 220); P4-G1-C8 (SEQ ID NOs:221 and 222); P4-G1-P1 (SEQ ID NOs:223 and 224); P4-G1-M1.3 (SEQ ID NOs: 225 and 226); P4-G1-M27 (SEQ ID NOs:227 and 228); P4-G1-P6 (SEQ ID NOs:229 and 230); P4-G1-B69 (SEQ ID NOs:231 and 232); M78-G1-C8 (SEQ ID NOs:233 and 234); M78-G1-P1 (SEQ ID NOs:235 and 236); M78-G1-M1.3 (SEQ ID NOs:237 and 238); M78-G1-M27 (SEQ ID NOs:239 and 240); M78-G1-P6 (SEQ ID NOs:241 and 242); M78-G1-B69 (SEQ ID NOs:243 and 244); M57-G1-C8 (SEQ ID NOs:245 and 246); M57-G1-P1 (SEQ ID NOs:247 and 248); M57-G1-M1.3 (SEQ ID NOs:249 and 250); M57-G1-M27 (SEQ ID NOs:251 and 252); M57-G1-P6 (SEQ ID NOs:253 and 254) and M57-G1-B69 (SEQ ID NOs:255 and 256).

SEQ ID NOs:257-296 are the nucleotide sequence (odd numbers) and aa sequences (even numbers) of the mature light and heavy chains of anti-ErbB3/anti-IGF-1R IgG1 (scFv)$_2$ provided in FIG. 5B, the sequence ID numbers of which are as follows. Lambda light chains: P1 (SEQ ID NOs:257 and 258); M27 (SEQ ID NOs:259 and 260); M7 (SEQ ID NOs:261 and 262); B72 (SEQ ID NOs:263 and 264); and B60 (SEQ ID NOs:265 and 266). Heavy chain scFv fusions (hybrids): P1-G1-P4 (SEQ ID NOs:267 and 268); P1-G1-M57 (SEQ ID NOs:269 and 270); P1-G1-M78 (SEQ ID NOs:271 and 272); M27-G1-P4 (SEQ ID NOs:273 and 274); M27-G1-M57 (SEQ ID NOs:275 and 276); M27-G1-M78 (SEQ ID NOs:277 and 278); M7-G1-P4 (SEQ ID NOs:279 and 280); M7-G1-M57 ((SEQ ID NOs:281 and 282); M7-G1-M78 (SEQ ID NOs:283 and 284); B72-G1-P4 (SEQ ID NOs:285 and 286); B72-G1-M57 (SEQ ID NOs:287 and 288); B72-G1-M78 (SEQ ID NOs:289 and 290); B60-G1-P4 (SEQ ID NOs:291 and 292); B60-G1-M57 (SEQ ID NOs:293 and 294); and B60-G1-M78 (SEQ ID NOs:295 and 296).

SEQ ID NOs:297 and 298 are the nucleotide and aa sequences of the light chain of 16F with a signal sequence, as shown in FIG. 7B.
SEQ ID NOs:299 and 300 are the nucleotide and aa sequences of the heavy chain of 16F with a signal sequence, as shown in FIG. 7A.
SEQ ID NO:301 is a portion of an exemplary heavy chain domain, wherein a lysine was inserted between the C-terminus of the CH3 domain and the N-terminus of the linker SLSLSPGKGGGGS (SEQ ID NO:301—the additional lysine is underlined).
SEQ ID NOs:302-304 are consensus sequences of anti-IGF-1R VHCDR1, VHCDR2 and VHCDR3 domains, respectively, which are the CDR sequences of the VH consensus sequence of SEQ ID NO:1 and shown in FIG. 1.
SEQ ID NOs:305-307 are consensus sequences of an anti-IGF-1R VLCDR1, VLCDR2 and VLCDR3, respectively, which are the CDR sequences of the VL consensus sequence of SEQ ID NO:2 and shown in FIG. 2.
SEQ ID NO:308 is a consensus sequence of an anti-IGF-1R VLCDR3, which is the CDR3 sequence of the VL consensus sequence of SEQ ID NO:3 and shown in FIG. 2.
SEQ ID NOs:209-311 are consensus sequences of anti-ErbB3 VHCDR1, VHCDR2 and VHCDR3 domains, respectively, which are the CDR sequences of the VH consensus sequence of SEQ ID NO:4 and shown in FIG. 3.
SEQ ID NOs:312-314 are consensus sequences of anti-ErbB3 VLCDR1, VLCDR2 and VLCDR3 domains, respectively, which are the CDR sequences of the VL consensus sequence of SEQ ID NO:6 and shown in FIG. 4.
SEQ ID NO:315 is a consensus sequence of an anti-ErbB3 VLCDR3, which is the CDR3 sequence of the VL consensus sequence of SEQ ID NO:7 and shown in FIG. 4.

SEQ ID NO:316 is the aa sequence of the heavy chain of the anti-ErbB3/anti-IGF-1R IgG2 tetravalent bispecific protein ELI-7.

SEQ ID NO:317 is the aa sequence of the light chain of the anti-ErbB3/anti-IGF-1R IgG2 tetravalent bispecific protein ELI-7.

SEQ ID NO:318 is the aa sequence of the heavy chain of the anti-IGF-1R/anti-ErbB3 tetravalent bispecific protein ILE-10.

SEQ ID NO:319 is the aa sequence of the heavy chain of the anti-IGF-1R/anti-ErbB3 tetravalent bispecific protein ILE-12.

SEQ ID NO:320 is the aa sequence of the light chain of the anti-IGF-1R/anti-ErbB3 tetravalent bispecific proteins ILE-10 and ILE-12.

SEQ ID NOs:321-335 are the aa sequences of Fab heavy chains (Fab HC), Fab light chains (Fab LC) and scFvs from the anti-IGF-1R antibodies of Table 1, which sequences are of FIG. 37.

TABLE 1 anti-IGF-1R antibodies

| Anti-IGF-1R | Fab HC | Fab LC | scFv |
|---|---|---|---|
| ANTI-IGF-1R Ab#C (figitumumab) | SEQ ID NO: 321 | SEQ ID NO: 322 | SEQ ID NO: 323 |
| ANTI-IGF-1R Ab#B (cixutumumab) | SEQ ID NO: 324 | SEQ ID NO: 325 | SEQ ID NO: 326 |
| ANTI-IGF-1R Ab# A (ganitumab) | SEQ ID NO: 327 | SEQ ID NO: 328 | SEQ ID NO: 329 |
| BIIB-G11 | SEQ ID NO: 330 | SEQ ID NO: 331 | SEQ ID NO: 332 |
| BIIB-C06 | SEQ ID NO: 333 | SEQ ID NO: 334 | SEQ ID NO: 335 |

SEQ ID NOs:336-353 are the aa sequences of Fab heavy chains (Fab HC), Fab light chains (Fab LC) and scFvs from the anti-ErbB3 antibodies of Table 2, which sequences are of FIG. 38.

TABLE 2 anti-ErbB3 antibodies

| Anti-ErbB3 | Fab HC | Fab LC | scFv |
|---|---|---|---|
| ANTI-ErbB3 Ab# A | SEQ ID NO: 336 | SEQ ID NO: 337 | SEQ ID NO: 338 |
| H3 | SEQ ID NO: 339 | SEQ ID NO: 340 | SEQ ID NO: 341 |
| MM Ab#3 | SEQ ID NO: 342 | SEQ ID NO: 343 | SEQ ID NO: 344 |
| MM Ab#14 | SEQ ID NO: 345 | SEQ ID NO: 346 | SEQ ID NO: 347 |
| MM Ab#17 | SEQ ID NO: 348 | SEQ ID NO: 349 | SEQ ID NO: 350 |
| XMM Ab#19 | SEQ ID NO: 351 | SEQ ID NO: 352 | SEQ ID NO: 353 |

SEQ ID NOs:354 and 355 are the nucleotide and aa sequences for the B60-IgG2-M78 polyvalent bispecific antibody shown in FIG. 5B.

SEQ ID NOs:356 and 357 are the nucleotide and aa sequences for the M7-IgG2-M78 polyvalent bispecific antibody shown in FIG. 5B.

SEQ ID NOs:358-360 are aa sequences of SF, P4, M78, and M57 anti-IGF-1R IgG1 monoclonal antibody heavy chains shown in FIG. 6A.

SEQ ID NOs:362-366 are aa sequences of P1, M27, M7, B72, and B60 anti-ErbB3 IgG1 monoclonal antibody heavy chains shown in FIG. 6B.

SEQ ID NOs:367-369 are aa sequences of P4, M57, and M78 anti-IGF-1R scFv monoclonal antibodies shown in FIG. 6C.

SEQ ID NOs:370-375 are aa sequences of C8, P1, M1.3, M27, P6, and B69 anti-ErbB3 scFv monoclonal antibodies shown in FIG. 6D.

SEQ ID NOs:376-379 are aa sequences of the heavy chains P4M-G1-M1.3, P4M-G1-C8, P33M-G1-M1.3, and P33M-G1-C8, respectively.

SEQ ID NOs:380 and 381 are aa sequences of P33M kappa light chain and P4M kappa light chain, respectively.

SEQ ID NOs:382 and 383 are aa sequences of the anti-IGF-1R scFv M76 and the anti-ErbB3 scFv P6L, respectively. The VH and VL domains of binding site M76 consist of the aa sequences of SEQ ID NOs:31 and 133, respectively.

SEQ ID NOs:384 and 385 are aa sequences of the VH domain of the anti-IGF-1R binding site modules P4M and P33M, respectively.

SEQ ID NOs:386 and 387 are aa sequences of the VL domain of the anti-IGF-1R binding site modules P4M and P33M, respectively.

SEQ ID NO:388 is the aa of the VH domain of the anti-ErbB3 binding site module P6L. The VL domain consists of the aa sequence of SEQ ID NO:173.

SEQ ID NOs: 389 and 390 are aa sequences of the anti-IGF-1R heavy chains P4M-G1-P6L and P33M-G1-P6L, respectively.

SEQ ID NO:391 is the aa sequence of the anti-ErbB3 heavy chain P1-G1-M76.

SEQ ID NO:392 is the aa sequence of the beginning of the CH1 portion of the hybrid heavy chains of FIGS. 5A and 5B.

SEQ ID NO:393 and 394 are aa sequences of the beginning of the CL domain in the anti-IGF-1R and ErbB3 VL domains of the light chains of FIGS. 5A and 5B, respectively.

SEQ ID NOs:395-402 are the aa sequence of exemplary Gly-Ser polypeptide linkers.

SEQ ID NO:403 is the aa sequence of a hexa-histidine tag.

SEQ ID NO:404 is the aa sequence of the IgG2 constant domain (including CH1, Hinge, CH2, and CH3 regions).

SEQ ID NOs:405-408 are the aa sequence of the heavy chains of SF-G1-P1, SF-G1-M27, M57-G1-C8, M7-G1-M78 heavy chains, respectively, including the leader sequence (the N-terminal 19 aas of each sequence).

SEQ ID NO:409 is the nucleotide sequence of the M7-G1-M78 heavy chain, including the leader sequence. SEQ ID NOs:410-411 are the aa and nucleotide sequences of the P4-G1-M1.3 heavy chain, respectively, including the leader sequence (the N-terminal 19 aas of the aa sequence).

SEQ ID NOs:412-413 are the aa and nucleotide sequences of the P4-G1-C8 heavy chain, respectively, including the leader sequence (the N-terminal 19 aas of the aa sequence).

SEQ ID NOs:414-415 are the aa and nucleotide sequences of the M7 Lambda Light Chain, respectively, including the leader sequence (the N-terminal 21 aas of the aa sequence).

SEQ ID NOs:416-417 are the aa and nucleotide sequences of the P4 Kappa Light Chain, respectively, including the leader sequence (the N-terminal 20 aas of the aa sequence).

SEQ ID NO:418 is the aa sequence of the IgG1 module with Hinge, CH2, and CH3 regions (the C-terminal 231 aas of the sequence).

SEQ ID NOs:419-424 are nucleotide sequences of the heavy chains P4M-G1-M1.3, P4M-G1-C8, P4M-G1-P6L, P33M-G1-M1.3, P33M-G1-C8, and P33M-G1-P6L respectively.

SEQ ID NO:425 is the nucleotide sequence of the P1-G1-M76 anti-ErbB3-G1/anti-EGF-1R bispecific antibody.

SEQ ID NOs:426 and 427 are nucleotide sequences of the P33M Kappa and P4M Kappa light chains, respectively.

SEQ ID NO:428 is the nucleotide sequence of the M76 anti-IGF-1R scFv.

SEQ ID NO:429 is the nucleotide sequence of the P6L anti-ErbB3 scFv.

DETAILED DESCRIPTION

Provided herein are novel monospecifc antibodies that bind specifically to IGF-1R or to ErbB3. Such antibodies include IgG antibodies and scFv antibodies. Further provided are bispecific antibodies, e.g., polyvalent bispecific antibodies ("PBAs") that bind specifically to human IGF-1R and to human ErbB3. These proteins are potent inhibitors of tumor cell proliferation and of signal transduction through either or both of IGF-1R and ErbB3. The proteins may be used for treating a cell proliferative disorder, e.g., a cancer.

Definitions

For convenience, the meaning of certain terms and phrases used in the specification, examples, and appended claims, are provided below.

"Agent," refers to an active molecule, e.g., a therapeutic protein, e.g., a drug.

"Aa substitution" refers to the replacement of one specific aa ("aa") in a protein with another aa. A substitution may be a conservative substitution, as defined below.

"Anti-ErbB3 binding site" refers to a binding site that binds specifically to human ErbB3.

"Anti-IGF-1R binding site" refers to a binding site that binds specifically to human IGF-1R.

"Antigen binding site" refers to a binding site that comprises the VH and/or VL domain of an antibody, or at least one CDR thereof. For example, an antigen binding site may comprise, consist essentially of, or consist of a VHCDR3 alone or together with a VHCDR2 and optionally a VHCDR1. In certain embodiments, an antigen binding site comprises a VH domain and a VL domain, which may be present on the same polypeptide or on two different polypeptides, e.g., the VH domain is present on a heavy chain and a VL domain is present on a light chain.

"Antigen-binding portion" of an antibody refers to one or more fragments of an antibody that retain the ability to specifically bind to an antigen (e.g., IGF-1R or ErbB3). It has been shown that the antigen-binding function of an antibody can be retained by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a F(ab')$_2$ fragment, a bivalent fragment comprising two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment which consists of a VH domain; and (vi) an isolated complementarity determining region (CDR). Furthermore, although VL and VH are two domains of an Fv fragment, VL and VH are coded for by separate genes, they can be joined, using recombinant methods, by a synthetic linker that enables them to be made as a single protein chain in which the VL and VH regions pair to form monovalent proteins, known as single chain Fvs (scFvs) see U.S. Pat. No. 5,892,019. Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites.

"Binding affinity" refers to the strength of a binding interaction and includes both the actual binding affinity as well as the apparent binding affinity. The actual binding affinity is a ratio of the association rate over the disassociation rate. The apparent affinity can include, for example, the avidity resulting from a polyvalent interaction. Dissociation constant ($K_d$), is typically the reciprocal of the binding affinity, and may be conveniently measured using a surface plasmon resonance assay (e.g., as determined in a BIACORE 3000 instrument (GE Healthcare) e.g., using recombinant ErbB3 as the analyte and an anti-ErbB3 antibody as the ligand) or a cell binding assay, each of which assays is described in Example 3 of U.S. Pat. No. 7,846,440.

"Binding moiety," "binding domain," or "binding site," refers to the portion, region, or site of a binding polypeptide or, when so specified, of a heavy or light chain thereof, that is directly involved in mediating the specific binding of an antibody to a target molecule (i.e. an antigen). Exemplary binding domains include an antigen binding site, a receptor binding domain of a ligand, a ligand binding domain of a receptor or an enzymatic domain. In preferred embodiments, the binding domain comprises or consists of an antigen binding site (e.g., comprising a variable heavy (VH) chain sequence and variable light (VL) chain sequence or six CDRs from an antibody placed into alternative framework regions (e.g., human framework regions optionally comprising one or more aa substitutions). In certain embodiments, a binding site may be comprised essentially only of a VH or a VL chain sequence. A binding site may be entirely from one species, e.g., it has only sequences that derive from the germline sequences of one species. For example, a binding site may be human (i.e., from the human species), mouse, or rat. A binding site may also be humanized, i.e., the CDRs are from one species and the frameworks (FRs) are from another species. For example, a binding site may have CDRs that were derived from a mouse antibody and FRs that are from the human species. Certain humanized binding sites comprise mutations in one or more CDR to make the CDRs look more like the CDRs of the donor antibody. Certain humanized antibodies may also comprise mutations in one or more FR. Generally mutations in a binding site may enhance the affinity of binding of the binding site to its target antigen, and/or they may stabilize the binding site, e.g., to extend its half-life.

"CDR" or "complementarity determining region" refers to the noncontiguous antigen combining sites found within the VR of both heavy and light chain polypeptides. These particular regions have been described by Kabat et al., J. Biol. Chem. 252, 6609-6616 (1977) and Kabat et al., Sequences of protein of immunological interest. (1991), and by Chothia et al., J. Mol. Biol. 196:901-917 (1987) and by MacCallum et al., J. Mol. Biol. 262:732-745 (1996) where the definitions include overlapping or subsets of aa residues when compared against each other. The aa residues which encompass the CDRs as defined by each of the above cited references are set forth for comparison. As used herein, and if not otherwise specified, "CDR" is as defined by Kabat.

TABLE 3

CDR definitions

| | Kabat[1] | Chothia[2] | MacCallum[3] |
|---|---|---|---|
| VHCDR1 | 31-35 | 26-32 | 30-35 |
| VHCDR2 | 50-65 | 53-55 | 47-58 |
| VHCDR3 | 95-102 | 96-101 | 93-101 |
| VLCDR1 | 24-34 | 26-32 | 30-36 |
| VLCDR2 | 50-56 | 50-52 | 46-55 |
| VLCDR3 | 89-97 | 91-96 | 89-96 |

[1]Residue numbering follows the nomenclature of Kabat et al., 1991, supra
[2]Residue numbering follows the nomenclature of Chothia et al., supra
[3]Residue numbering follows the nomenclature of MacCallum et al., supra "CH1 domain" refers to the heavy chain immunoglobulin constant domain located between the VH domain and the hinge. It spans EU positions 118-215. A CH1 domain may be a naturally occurring CH1 domain, or a naturally occurring CH1 domain in which one or more aas have been substituted, added or deleted, provided that the CH1 domain has the desired biological properties. A desired biological activity may be a natural biological activity, an enhanced biological activity or a reduced biological activity relative to the naturally occurring sequence.

"CH2 domain" refers to the heavy chain immunoglobulin constant domain that is located between the hinge and the CH3 domain. It spans EU positions 231-340. A CH2 domain may be a naturally occurring CH2 domain, or a naturally occurring CH2 domain in which one or more aas have been substituted, added or deleted, provided that the CH2 domain has the desired biological properties. A desired biological activity may be a natural biological activity, an enhanced biological activity or a reduced biological activity relative to the naturally occurring sequence.

"CH3 domain" refers to the heavy chain immunoglobulin constant domain that is located C-terminally of the CH2 domain and spans approximately 110 residues from the N-terminus of the CH2 domain, e.g., about positions 341-446b (EU numbering system). A CH3 domain may be a naturally occurring CH3 domain, or a naturally occurring CH3 domain in which one or more aas ("aas") have been substituted, added or deleted, provided that the CH3 domain has the desired biological properties. A desired biological activity may be a natural biological activity, an enhanced biological activity or a reduced biological activity relative to the naturally occurring sequence. A CH3 domain may or may not comprise a C-terminal lysine.

"CH4 domain" refers to the heavy chain immunoglobulin constant domain that is located C-terminally of the CH3 domain in IgM and IgE antibodies. A CH4 domain may be a naturally occurring CH4 domain, or a naturally occurring CH4 domain in which one or more aas have been substituted, added or deleted, provided that the CH4 domain has the desired biological properties. A desired biological activity may be a natural biological activity, an enhanced biological activity or a reduced biological activity relative to the naturally occurring sequence.

"CL domain" refers to the light chain immunoglobulin constant domain that is located C-terminally to the VH domain. It spans about Kabat positions 107A-216. A CL domain may be a naturally occurring CL domain, or a naturally occurring CL domain in which one or more aas have been substituted, added or deleted, provided that the CL domain has the desired biological properties. A desired biological activity may be a natural biological activity, an enhanced biological activity or a reduced biological activity relative to the naturally occurring sequence. A CL domain may or may not comprise a C-terminal lysine.

"Conservative substitution" or "conservative aa substitution" refers to the replacement of one or more aa residues in a protein or a peptide with, for each particular pre-substitution aa residue, a specific replacement aa that is known to be unlikely to alter either the confirmation or the function of a protein or peptide in which such a particular aa residue is substituted for by such a specific replacement aa. Such conservative substitutions typically involve replacing one aa with another that is similar in charge and/or size to the first aa, and include replacing any of isoleucine (I), valine (V), or leucine (L) for each other, substituting aspartic acid (D) for glutamic acid (E) and vice versa; glutamine (Q) for asparagine (N) and vice versa; and serine (S) for threonine (T) and vice versa. Other substitutions are known in the art to be conservative in particular sequence or structural environments. For example, glycine (G) and alanine (A) can frequently be substituted for each other to yield a conservative substitution, as can be alanine and valine (V). Methionine (M), which is relatively hydrophobic, can frequently conservatively substitute for or be conservatively substituted by leucine or isoleucine, and sometimes valine. Lysine (K) and arginine (R) are frequently interchangeable in locations in which the significant feature of the aa residue is its charge and the differing pK's of these two basic aa residues are not expected to be significant. The effects of such substitutions can be calculated using substitution score matrices such PAM120, PAM-200, and PAM-250. Other such conservative substitutions, for example, substitutions of entire regions having similar hydrophobicity characteristics (e.g., transmembrane domains), are well known.

A CR domain on a light chain of an immunoglobulin is referred to interchangeably as a "CL," "light chain CR domain," "CL region" or "CL domain." A constant domain on a heavy chain (e.g., hinge, CH1, CH2 or CH3 domains) of an immunoglobulin is referred to interchangeably as a "CH," "heavy chain constant domain," "CH" region or "CH domain." A variable domain on an immunoglobulin light chain is referred to interchangeably as a "VL," "light chain variable domain," "VL region" or "VL domain." A variable domain on an immunoglobulin heavy chain is referred to interchangeably as a "VH," "heavy chain variable domain," "VH region" or "VH domain."

"Domain" refers to a region, e.g., an independently folding, globular region or a non-globular region (e.g., a linker domain), of a heavy or light chain polypeptide which may comprise peptide loops (e.g., 1 to 4 peptide loops) that may be stabilized, for example, by a β-pleated sheet and/or an intra-chain disulfide bond. The constant and VRs of immunoglobulin heavy and light chains are typically folded into domains. In particular, each one of the CH1, CH2, CH3, CH4, CL, VH and VL domains typically form a loop structure.

"$EC_{50}$" or "EC50" refers to the concentration of a molecule, e.g., a PBA, that provides 50% of the maximal effect of the protein on a particular system such as a binding assay or a signal transduction pathway.

"ErbB3" and "HER3" refer to ErbB3 protein, as described in U.S. Pat. No. 5,480,968. The human ErbB3 protein sequence is shown in FIG. 4 and SEQ ID NO:4 of U.S. Pat. No. 5,480,968, wherein the first 19 aas correspond to the leader sequence that is cleaved from the mature protein. ErbB3 is a member of the ErbB family of receptors, other members of which include ErbB1 (EGFR), ErbB2 (HER2/Neu) and ErbB4. While ErbB3 itself lacks tyrosine kinase activity, but is itself phorphorylated upon dimerization of ErbB3 with another ErbB family receptor, e.g., ErbB1, ErbB2 and ErbB4, which are receptor tyrosine kinases. Ligands for the ErbB family include heregulin (HRG), betacellulin (BTC), epidermal growth factor (EGF), heparin-binding epidermal growth factor (HB-EGF), transforming growth factor alpha (TGF-α), amphiregulin (AR), epigen (EPG) and epiregulin (EPR). The aa sequence of human ErbB3 is provided at Genbank Accession No. NP_001973.2 (receptor tyrosine-protein kinase erbB-3 isoform 1 precursor) and is assigned Gene ID: 2065.

"EU" indicates that aa positions in a heavy chain CR, including aa positions in the CH1, hinge, CH2, and CH3 domains, are numbered herein according to the EU index numbering system (see Kabat et al., in "Sequences of Proteins of Immunological Interest", U.S. Dept. Health and Human Services, $5^{th}$ edition, 1991).

"Fab" refers to the antigen binding portion of an antibody, comprising two chains: a first chain that comprises a VH domain and a CH1 domain and a second chain that comprises a VL domain and a CL domain. Although a Fab is typically described as the N-terminal fragment of an antibody that was treated with papain and comprises a portion of the hinge region, it is also used herein as referring to a binding domain wherein the heavy chain does not comprise a portion of the hinge.

"Fc region" refers to the portion of a single immunoglobulin heavy chain beginning in the hinge region just upstream of the papain cleavage site (i.e. residue 216 in IgG, taking the first residue of heavy chain CR to be 114) and ending at the C-terminus of the antibody. Accordingly, a complete Fc region comprises at least a hinge, a CH2 domain, and a CH3 domain. Two Fc regions that are dimerized are referred to as "Fc" or "Fc dimer." An Fc region may be a naturally occurring Fc region, or a naturally occurring Fc region in which one or more aas have been substituted, added or deleted, provided that the Fc region has the desired biological properties. A desired biological activity may be a natural biological activity, an enhanced biological activity or a reduced biological activity relative to the naturally occurring sequence.

"Framework region" or "FR" or "FR region" includes the aa residues that are part of the VR, but are not part of the CDRs (e.g., using the Kabat definition of CDRs). Therefore, a VR framework is between about 100-120 aas in length but includes only those aas outside of the CDRs. For the specific example of a heavy chain VR and for the CDRs as defined by Kabat et al., 1991, ibid., framework region 1 corresponds to the domain of the VR encompassing aas 1-30; framework region 2 corresponds to the domain of the VR encompassing aas 36-49; framework region 3 corresponds to the domain of the VR encompassing aas 66-94, and framework region 4 corresponds to the domain of the VR from aas 103 to the end of the VR. The framework regions for the light chain are similarly separated by each of the light chain VR CDRs. Similarly, using the definition of CDRs by Chothia et al. or McCallum et al. the framework region boundaries are separated by the respective CDR termini as described above. In preferred embodiments, the CDRs are as defined by Kabat.

"Full-length antibody" is an antibody that comprises one or more heavy chains and one or more light chains. Each heavy chain is comprised of a heavy chain VR (abbreviated herein as VH) and a heavy chain CR. The heavy chain CR is comprised of three domains CH1, CH2, and CH3, and optionally a fourth domain, CH4. Each light chain is comprised of a light chain VR (abbreviated herein as VL) and a light chain CR. The light chain CR is comprised of one domain, CL. The VH and VL regions can be further subdivided into regions of hypervariability, termed complementarity determining regions (CDR), interspersed with regions that are more conserved, termed framework regions (FR). Each VH and VL is typically composed of three CDRs and four FRs, arranged from amino-terminus to carboxy-terminus in the following order: FR1, CDR1, FR2, CDR2, FR3, CDR3, and FR4. Immunoglobulin proteins can be of any type class (e.g., IgG, IgE, IgM, IgD, IgA and IgY) or, subclass (e.g., IgG 1, IgG2, IgG 3, IgG4, IgA1 and IgA2) or subclass.

"Gly-Ser linker" or "Gly-Ser peptide" refers to a peptide that consists of glycine and serine residues. An exemplary Gly-Ser peptide comprises the aa sequence $(Gly_4Ser)n$ (SEQ ID NO:395), wherein n=1, 2, 3, 4, 5, 6, 7, 8, 9, 10, 11, 12, 13, 14, 15, 16, 17, 18, 19, 20 or more. In certain embodiments, n is a number between 1 and 5, n is a number between 6 and 10, n is a number between 11 and 15, n is a number between 16 and 20, n is a number between 21 and 25, or n is a number between 26 and 30.

"Heavy chain immunoglobulin CR" or "HC Ig CR" may comprise a CH1 domain and an Fc region, which Fc region may comprise a hinge, a CH2 domain, a CH3 domain and/or a CH4 domain. A light chain immunoglobulin CR may comprise a CL domain.

"Hinge" or "hinge region" or "hinge domain" refers to the flexible portion of a heavy chain located between the CH1 domain and the CH2 domain. It is approximately 25 aas long, and is divided into an "upper hinge," a "middle hinge," and a "lower hinge." A hinge may be a naturally occurring hinge, or a naturally occurring hinge in which one or more aas have been substituted, added or deleted, provided that the hinge has the desired biological properties. A desired biological activity may be a natural biological activity, an enhanced biological activity or a reduced biological activity relative to the naturally occurring sequence.

"$IC_{50}$," or "IC50" refers to the concentration of a molecule, e.g., a PBA, that provides a 50% inhibition of a maximal activity (e.g., a response to a stimulus or a constitutive activity), i.e., a concentration that reduces the activity to a level halfway between the maximal activity and the baseline. The $IC_{50}$ value may be converted to an absolute inhibition constant (Ki) using, e.g., the Cheng-Prusoff equation. In a system that is inhibited by a binding agent, such as an antibody or a bispecific binding protein provided herein, the IC50 may be indistinguishable from the EC50.

"IGF-1R" or "IGF1R" refers to the receptor for insulin-like growth factor 1 (IGF-1, formerly known as somatomedin C). IGF-1R also binds to, and is activated by, insulin-like growth factor 2 (IGF-2). IGF1-R is a receptor tyrosine kinase, which upon activation by IGF-1 or IGF-2 is auto-phosphorylated. The aa sequence of human IGF-1R precursor is provided at Genbank Accession No. NP_000866 and is assigned Gene ID: 3480.

"IgG-(scFv)$_2$" indicates a tetravalent PBA consisting of an IgG having two N-terminal Fab binding sites each comprised of an IgG heavy chain and an IgG light chain, wherein the C-terminus of each heavy chain is linked to an scFv having a binding site comprised of a VH domain and a VL domain. When the immunoglobulin CRs are those of an IgG1, the PBA is referred to as an "IgG1-(scFv)$_2$." Exemplary IgG1-(scFv)$_2$ PBAs are those where the four binding sites comprise two essentially identical anti-IGF-1R binding sites and two essentially identical anti-ErbB3 binding sites. The 38 tetravalent PBAs set forth below in the Detailed Description under the subheading "Exemplary IGF-1R+ErbB3 PBAs comprising IgG1 CRs" (also see FIGS. 5A and B), each comprise two joined essentially identical subunits, each subunit comprising a heavy and a light chain that are disulfide bonded to each other, e.g., M7-G1-M78 (SEQ ID NO:284 and SEQ ID NO:262), P4-G1-M1.3 (SEQ ID NO:226 and SEQ ID NO:204), and P4-G1-C8(SEQ ID NO:222 and SEQ ID NO:204), are exemplary embodiments of such IgG1-(scFv)₂proteins. When the immunoglobulin CRs are those of IgG2, the protein is referred to as an "IgG2-(scFv)₂." An exemplary "IgG2-(scFv)₂ protein is ELI-7. When the immunoglobulin CRs are partially from an IgG1 and partially from another isotype of IgG, e.g., an IgG2, the protein is referred to as e.g., an "IgG1/2-(scFv)₂."

"Immunoglobulin CR" or "Ig CR" refers to the parts of an immunoglobulin, (i.e., an antibody,) outside of its variable domains. In certain embodiments, an immunoglobulin CR comprises a "heavy chain immunoglobulin CR" and a "light chain immunoglobulin CR."

"Inhibition" of a biological activity by a binding protein refers to any reproducibly detectable decrease in biological activity mediated by the binding protein. In some embodiments, inhibition provides a statistically significant decrease in biological activity, e.g., a decrease of about 5%, 10%, 20%, 30%, 40%, 50%, 60%, 70%, 80%, 90%, or 100% in biological activity relative to the biological activity determined in he absence of the binding protein.

"Isolated," in reference to polynucleotides, polypeptides or proteins, means that the polynucleotide, polypeptide or protein is substantially removed from polynucleotides, polypeptides, proteins or other macromolecules with which it, or its analogues, occurs in nature. Although the term "isolated" is not intended to require a specific degree of purity, typically, the protein will be at least about 75% pure, more preferably at least about 80% pure, more preferably at least about 85% pure, more preferably at least about 90% pure, more preferably still at least about 95% pure, and most preferably at least about 99% pure.

"Kabat" in conjunction with designation of immunoglobulin aa sequence positions indicates that aa positions in a light chain CR (e.g., CL domain) are numbered according to the Kabat index numbering system (see Kabat et al., 1991., op. cit.).

"Linked to" refers to direct or indirect linkage or connection of, in context, aas or nucleotides. An "indirect linkage" refers to a linkage that is mediated through a linker or a domain, comprising, e.g., one or more aas or nucleotides. A "direct linkage" or "linked directly" when referring to two polypeptide segments refers to the presence of covalent bond between the two polypeptide segments, e.g., the two polypeptide segments are joined contiguously without intervening sequences.

"Linker" refers to one or more aas connecting two domains or regions together. A linker may be flexible to allow the domains being connected by the linker to form a proper three dimensional structure thereby allowing them to have the required biological activity. A linker connecting the VH and the VL of an scFv is referred to herein as an "scFv linker." A linker connecting the N-terminus of a VH domain or the C-terminus of the CH3 domain to a second VH domain, e.g., that of an scFv is referred to as a "connecting linker."

"Module" refers to a structurally and/or functionally distinct part of a PBA, such a binding site (e.g., an scFv domain or a Fab domain) and the Ig constant domain. Modules provided herein can be rearranged (by recombining sequences encoding them, either by recombining nucleic acids or by complete or fractional de novo synthesis of new polynucleotides) in numerous combinations with other modules to produce a wide variety of PBAs, e.g., as disclosed herein. For example, an "SF" module refers to the binding site "SF," i.e., comprising at least the CDRs of the SF VH and SF VL domains. A "C8" module refers to the binding site "C8."

"PBA" refers to a polyvalent bispecific antibody, an artificial hybrid protein comprising at least two different binding moieties or domains and thus at least two different binding sites (e.g., two different antibody binding sites), wherein one or more of the pluralities of the binding sites are covalently linked, e.g., via peptide bonds, to each other. A preferred PBA described herein is an anti-IGF-1R+anti-ErbB3 PBA, which is a polyvalent bispecific antibody that comprises one or more first binding sites binding specifically to an IGF-1R protein, e.g., a human IGF-1R protein, and one or more second binding sites binding specifically to an ErbB3 protein, e.g., a human ErbB3 protein. An anti-IGF-1R+anti-ErbB3 PBA is so named regardless of the relative orientations of the anti-IGF-1R and anti-ErbB3 binding sites in the molecule, whereas when the PBA name comprises two antigens separated by a slash (/) the antigen to the left of the slash is amino terminal to the antigen tot the right of the slash. A PBA may be a bivalent binding protein, a trivalent binding protein, a tetravalent binding protein or a binding protein with more than 4 binding sites. An exemplary PBA is a tetravalent bispecific antibody, i.e., an antibody that has 4 binding sites, but binds to only two different antigens or epitopes. Exemplary bispecific antibodies are tetravalent "anti-IGF-1R/anti-ErbB3" PBAs and "anti-ErbB3/anti-IGF-1R" PBAs. Typically the N-terminal binding sites of a tetravalent PBA are Fabs and the C-terminal binding sites are scFvs.

"Percent identical" or "% identical" refers to two or more nucleic acid or polypeptide sequences or subsequences that are the same (100% identical) or have a specified percentage of nucleotide or aa residues that are the same, when the two sequences are aligned for maximum correspondence and compared. To align for maximum correspondence, gaps may be introduced into one of the sequences being compared. The aa residues or nucleotides at corresponding positions are then compared and quantified. When a position in the first sequence is occupied by the same residue as the corresponding position in the second sequence, then the sequences are identical at that position. The percent identity between the two sequences is a function of the number of identical positions shared by the sequences (e.g., % identity=# of identical positions/total # of positions (e.g., overlapping positions)× 100). In certain embodiments, the two sequences are the same length. The determination that one sequence is a measured % identical with another sequence can be determined using a mathematical algorithm. A non-limiting example of a mathematical algorithm utilized for such comparison of two sequences is incorporated in the ALIGN program (version 2.0) which is part of the GCG sequence alignment software package. When utilizing the ALIGN program e.g., for comparing aa sequences, a PAM120 weight residue table, a gap length penalty of 12, and a gap penalty of 4 may be used. Additional algorithms for sequence analysis are well known in the art and many are available online.

"Portion" or "fragment" (e.g., of a domain) of a reference moiety refers to a discrete part of the whole reference moiety (e.g., domain, e.g., a naturally occurring domain) that is at least, or at most 10% 20%, 30%, 40%, 50%, 60%, 70%, 80%, 90%, 95%, 98%, or 99% of the size of the reference moiety.

"scFv linker" refers to a peptide or polypeptide domain interposed between the VL and VH domains of an scFv. scFv linkers preferably allow orientation of the VL and VH domains in a antigen binding conformation. In one embodiment, an scFv linker comprises or consists of a peptide or polypeptide linker that only comprises glycines and serines (a "Gly-Ser linker"). In certain embodiments, an scFv linker comprises a disulfide bond.

"scFv protein" refers to a binding protein that consists of a single polypeptide comprising one light chain variable domain (VL), and one heavy chain variable domain (VH), wherein each variable domain is derived from the same or different antibodies. scFv proteins typically comprise an scFv linker interposed between the VH domain and the VL domain. ScFv proteins are known in the art and are described, e.g., in U.S. Pat. No. 5,892,019.

"Similarity" or "percent similarity" in the context of two or more polypeptide sequences, refer to two or more sequences or subsequences that have a specified percentage of aa residues that are the same or conservatively substituted when compared and aligned for maximum correspondence. By way of example, a first aa sequence can be considered similar to a second aa sequence when the first aa sequence is at least 50%, 60%, 70%, 75%, 80%, 90%, or even 95% identical, or conservatively substituted, to the second aa sequence when compared to an equal number of aas as the number contained in the first sequence, or when compared to an alignment of polypeptides that has been aligned by a computer similarity program known in the art. These terms are also applicable to two or more polynucleotide sequences.

"Specific binding," "specifically binds," "selective binding," and "selectively binds," as well as "binds specifically" "binds selectively," when referring to the binding of a binding site to its target epitope or a combination of binding sites to their target epitopes, means that the binding site(s) exhibit(s) immunospecific binding to the target epitope(s). A binding site that binds specifically to an epitope exhibits appreciable affinity for a target epitope and, generally, does not exhibit cross-reactivity with other epitopes in that it does not exhibit appreciable affinity to any unrelated epitope and preferably does not exhibit affinity for any unrelated epitope that is equal to, greater than, or within two orders of magnitude lower than the affinity for the target epitope. "Appreciable" or preferred binding includes binding with a dissociation constant (Kd) of $10^{-8}$, $10^{-9}$ M, $10^{-10}$, $10^{-11}$, $10^{-12}$ M, $10^{-13}$ M or an even lower Kd value. Note that lower values for Kd (dissociation constant) indicate higher binding affinity, thus a Kd of $10^{-7}$ is a higher Kd value than a Kd of $10^{-8}$, but indicates a lower binding affinity than a Kd of $10^{-8}$). Dissociation constants with values of about $10^{-7}$ M, and even as low as about $10^{-8}$ M, are at the high end of dissociation constants suitable for therapeutic antibodies. Binding affinities may be indicated by a range of dissociation constants, for example, $10^{-6}$ to $10^{-12}$ M, $10^{-7}$ to $10^{-12}$ M, $10^{-8}$ to $10^{-12}$ M or better (i.e., or lower value dissociation constant). Dissociation constants in the nanomolar ($10^{-9}$ M) to picomolar ($10^{-12}$ M) range or lower are typically most useful for therapeutic antibodies. Suitable dissociation constants are Kds of 50 nM or less (i.e., a binding affinity of 50 nM or higher—e.g., a Kd of 45 nM) or Kds of 40 nM, 30 nM, 20 nM, 10 nM, 1 nm, 100 pM, 10 pM or 1 pM or less. Specific or selective binding can be determined according to any art-recognized means for determining such binding, including, for example, according to Scatchard analysis and/or competitive binding assays.

Polyvalent Bispecific Antibodies

Provided herein are polyvalent bispecific antibodies ("PBAs"), which may be isolated monoclonal antibodies. Exemplary PBAs comprise at least one anti-IGF-1R binding site and at least one anti-ErbB3 binding site or at least two anti-IGF-1R binding sites and at least two anti-ErbB3 binding sites. In a preferred embodiment, the anti-IGF-1R binding site binds specifically to a human IGF-1R and the anti-ErbB3 binding site binds specifically to human ErbB3. In certain embodiments, the PBA comprises two heavy-light chain pairs that associate with each other to form a single protein, wherein each heavy-light chain pair comprises an anti-IGF-1R binding site and an anti-ErB3 binding site. In certain embodiments, the anti-IGF-1R binding site and the anti-ErbB3 binding site of a first heavy-light chain pair are connected through an immunoglobulin CR that associates with the immunoglobulin CR of another heavy-light chain pair (e.g., by disulfide bonds) to form, e.g., a single IgG-like protein. A preferred PBA as described herein has advantageous properties, such as the ability to inhibit tumor cell proliferation and to reduce or stabilize tumor growth equivalently to or more potently than either its isolated anti-IGF-1R binding moiety or its isolated anti-ErbB3 binding moiety, and in certain embodiments, the ability to inhibit either or both of tumor invasiveness and tumor metastasis. An exemplary PBA described herein can inhibit either or both of IGF-1R and ErbB3 mediated signal transduction, such as IGF-1R, ErbB3 and AKT phosphorylation, equivalently to or more potently than either its isolated anti-IGF-1R binding moiety or its isolated anti-ErbB3 binding moiety. An exemplary PBA will (i) inhibit growth of tumor cells, e.g., by at least 10%, 20%, 30%, 40%, 50%, 60%, 70%, 80%, 90% or more; or (ii) inhibit IGF-1r, ErbB3 or Akt phosphorylation, e.g., by at least 10%, 20%, 30%, 40%, 50%, 60%, 70%, 80%, 90% or more, e.g., to a similar extent or more potently than either its isolated anti-IGF-1R binding moiety or its isolated anti-ErbB3 binding moiety, or both (i) and (ii). An exemplary PBA will (iii) be stable, e.g., be at least 80% monomeric in a solution after 1, 2, 3, 4, 5 or more days at 4° C., room temperature or 37° C., or (iv) have a Tm (e.g., as determined by DSF) of at least 50° C., 55° C., 60° C., 65° C. or more, or both (iii) and (iv). The PBAs described herein may be used, e.g., for treating a subject having a cancer.

In certain embodiments, the immunoglobulin CR of a PBA may comprise the CR of an IgG heavy chain, which may comprise an Fc region. An immunoglobulin constant domain may exist as a heavy-light chain pair, the heavy chain Fc region of which may comprise a CH3 domain that associates (e.g., by disulfide bonds) with the CH3 domain of another such heavy-light chain pair. The immunoglobulin CR moiety may also comprise a CH2 domain, a hinge and/or a CH1 domain. As further described herein, each of a CH1, hinge, CH2, or CH3 domain of a PBA may be a naturally occurring (or wild type) domain, or it may differ from a naturally occurring domain by one or more aa substitutions (e.g., conservative substitutions), additions or deletions, provided that the particular domain retains its desired biological activity, such as either or both of CH3 and CL association activity. When present, the CH1, hinge, CH2 and CH3 domains are preferably in N- to C-terminal order as they occur naturally, i.e., CH1, hinge, CH2, CH3. These domains may be connected, or linked, to each other directly or indirectly. An indirect linkage is a linkage that is mediated through a linker of one or more aas. In one embodiment, each CH domain is directly linked to its adjacent domains. Accordingly, in one embodiment, a CH1 domain is linked at its C-terminus to the N-terminus of a hinge domain, which is linked at its C-terminus to the N-terminus of a CH2 domain, which is linked at its C-terminus to the N-terminus of a CH3 domain.

Certain PBAs comprise at least two anti-IGF-1R and at least two anti-ErbB3 binding sites, each of which bind specifically to IGF-1R or ErbB3, respectively. The binding sites may be any type of immunoglobulin-derived or mimetic binding site, provided that each binding site binds specifically to its respective target. For example, a binding site may be a Fab domain, an scFv, or a fragment of a single domain antibody. The anti-IGF-1R and anti-ErbB3 binding sites of a PBA may be the same type of binding site or a different type. For example, the anti-IGF-1R binding sites may be Fabs and the anti-ErbB3 binding sites may be scFvs. Alternatively, the anti-IGF-1R binding sites may be scFvs and the anti-ErbB3 binding sites may be Fabs. In another embodiment, one anti-ErbB3 binding site is a Fab and another anti-ErbB3 binding site is an scFv; in another embodiment, one anti-IGF-1R binding site is a Fab and another anti-IGF-1R binding site is an scFv. In some embodiments, a first and a second Fab are linked to the N-terminus and C-terminus of the immunoglobulin CR domain, respectively. In some embodiments, a first and a second scFv are linked to the N-terminus and C-terminus of the immunoglobulin CR domain, respectively. In some embodiments, at least one Fab domain is linked to the N-terminus of the immunoglobulin CR (e.g., in the Fab and CRs' natural arrangement) and at least one scFv is linked to the C-terminus of the immunoglobulin CR. In some embodiments, at least one scFv is linked to the N-terminus of the immunoglobulin CR and at least one Fab is linked to the C-terminus of the immunoglobulin CR. Exemplary arrangements of Fab and scFv and anti-IGF-1R and anti-ErbB3 bispecific antibodies are of Table 4.

TABLE 4

Exemplary anti-IGF-1R and anti-ErbB3 arrangements in PBAs

| | | Linkage to the N-terminus of the immunoglobulin CR | | | |
|---|---|---|---|---|---|
| | | anti-IGF-1R scFv | Anti-IGF-1R Fab | Anti-ErbB3 scFv | Anti-ErbB3 Fab |
| Linkage to the C-terminus of the immunoglobulin CR | Anti-IGF-1R scFv | | | yes | yes |
| | Anti-IGF-1R Fab | | | yes | yes |
| | Anti-ErbB3 scFv | yes | yes | | |
| | Anti-ErbB3 Fab | yes | yes | | |

In certain embodiments, the immunoglobulin CR of a PBA comprises a CH1 domain that is linked to a first heavy chain variable domain (VH) domain. For example the CH1 domain may be linked at the N-terminus to the C-terminus of a first VH domain.

In certain embodiments, the immunoglobulin CR of a PBA comprises a CH3 that is linked to a second VH domain. When referring to first and second binding sites of an IgG based (e.g., derived from or comprising at least part of the CR of and IgG) PBA provided herein, the "first" binding site refers to the binding site that is located N-terminally to the immunoglobulin CR moeity, whereas the "second" binding site is the binding site that is located C-terminally to the immunoglobulin CR moeity. For example a CH3 domain can be linked at its C-terminus to the N-terminus of a second VH domain. The CH3 domain may be linked at its C terminus to the N-terminus of a linker, which linker is linked at its C-terminus to the N-terminus of the second VH domain. Such a linker may be useful to provide flexibility between the constant immunoglobulin region and the second VH domain, such that a proper three-dimensional structure may be obtained to allow the protein to have a biological activity.

In certain embodiments, a PBA comprises two binding sites that are antigen-binding sites as typically found in antibodies (i.e., it comprises two Fabs). Such PBAs usually comprise two light chains, wherein each light chain comprises a light chain variable (VL) domain that associates with (e.g., by disulfide binding) the VH domain of each of two heavy chains, to form two binding sites. The VL domain may be linked to a constant light chain (CL) domain and form a light chain Fab region. For example, a VL domain may be linked at its C-terminus to the N-terminus of a CL domain. In embodiments in which the first and the second binding sites are Fabs, the PBA has two different light chains, referred to as a first and a second light chain, wherein the first and the second light chains comprise a first and a second VL domain, respectively, and optionally a first and a second CL domain, respectively, and associate (e.g., dimerize) with the first and the second VH domain and optionally a first and a second CH1 domain, respectively.

In embodiments in which a PBA comprises one or more scFvs, the VH domain of each scFv is linked to an scFv linker, which is linked to a VL domain, and a VH domain and a VL domain associate with each other to form an antigen binding site. In one embodiment, a VH domain is linked at its C-terminus to the N-terminus of an scFv linker, which is linked at its C-terminus to the N-terminus of a VL domain. In embodiments in which one scFv is linked to the N-terminus of an immunoglobulin CR and one scFv is linked to its C-terminus, the N-terminus of the immunoglobulin CR is linked to a first VH domain, which is linked to a first scFv linker, which is linked to a first VL domain, and the first VH domain and the first VL domain form the first binding site; and the C-terminus of the immunoglobulin CR is linked to a second VH domain, which is linked to a second scFv linker, which is linked to a second VL domain, and the second VH domain and the second VL domain form the second binding site and two such immunoglobulin CRs are dimerized or otherwise associated (e.g., by at least one bond, e.g., a disulfide bond or a van der Waals bond) to form a single tetravalent protein.

In preferred embodiments, the immunoglobulin CR is a human immunoglobulin CR, i.e., it essentially consists of an aa sequence obtained from the human immunoglobulin repertoire. The immunoglobulin CR may be that of any immunoglobulin isotype, class or subclass. In one embodiment, an immunoglobulin CR is an IgG CR, such as an IgG1, IgG2, IgG3 or IgG4 CR. In certain embodiments, the CR is a hybrid that is made up of at least two different classes or subclasses or types of immunoglobulins. For example, an immunoglobulin CR may have one domain from IgG1 and one or more other domains from an IgG4 protein. As further described herein, in certain embodiments, a domain (e.g., CH1, hinge, CH2 or CH3) within the immunoglobulin CR may be mostly from one isotype of immunoglobulin, but may have one or more aa mutation(s) (e.g., substitution, addition or deletion) e.g., to provide the mutated immunoglobulin CR an attribute from another type or class of immunoglobulin CR.

In certain embodiments, a PBA has an IgG-(scFv)$_2$ structure. Such proteins comprise an IgG antibody having two first binding sites, to which is linked an scFv having a second binding site, e.g., to each of the two C-termini of the IgG protein. An exemplary IgG-(scFv)$_2$ is an IgG1-(scFv)$_2$, wherein the IgG is an IgG 1.

In certain embodiments, a PBA comprises a heavy chain having the structure represented by scFv-Fc-scFv and the PBA may have the structure (scFv-Fc-scFv)$_2$. The Fc may be an Fc region comprising a hinge, a CH2 and a CH3 domain. In certain embodiments, such proteins do not comprise a CH1 or a CL domain.

In one embodiment, a PBA comprises two identical heavy-light chain pairs that form an IgG like molecule, wherein each pair comprises one binding moiety that is an anti-IGF-1R Fab and another binding moiety that is an anti-ErbB3 scFv and wherein the two binding moieties are connected through an immunoglobulin CR, which comprises in N-terminal to C-terminal order a hinge domain, a CH2 domain and a CH3 domain. The scFv may be linked to the CH3 domain via a linker. In an exemplary embodiment, a PBA comprises two identical heavy chains that form a dimer and two identical light chains, wherein each light chain associates with a heavy chain, and wherein each heavy chain comprises: a first VH domain that is linked at its C-terminus to the N-terminus of a CH1 domain, which CH1 domain is linked at its C-terminus to the N-terminus of a hinge domain, which hinge domain is linked at its C-terminus to the N-terminus of a CH2 domain, which CH2 domain is linked at its C-terminus to the N-terminus of a CH3 domain, which CH3 domain is linked at its C-terminus to the N-terminus of a linker, which linker is linked at its C-terminus to the N-terminus of a second VH domain, which second VH domain is linked at its C-terminus to the N-terminus of an scFv linker, which scFv linker is linked at its C-terminus to the N-terminus of a second VL domain, which second VL domain associates with the second VH domain to form the second binding site; and wherein each light chains comprises a first VL domain that is linked at its C-terminus to the N-terminus of a CL domain, wherein the first VH domain and the first VL domain form the first binding site. In one embodiment, the first binding site is an anti-IGF-1R binding site and the second binding site is an anti-ErbB3 binding site. In another embodiment, the first binding site is an anti-ErbB3 binding site and the second binding site is an anti-IGF-1R binding site.

Figure 1A:
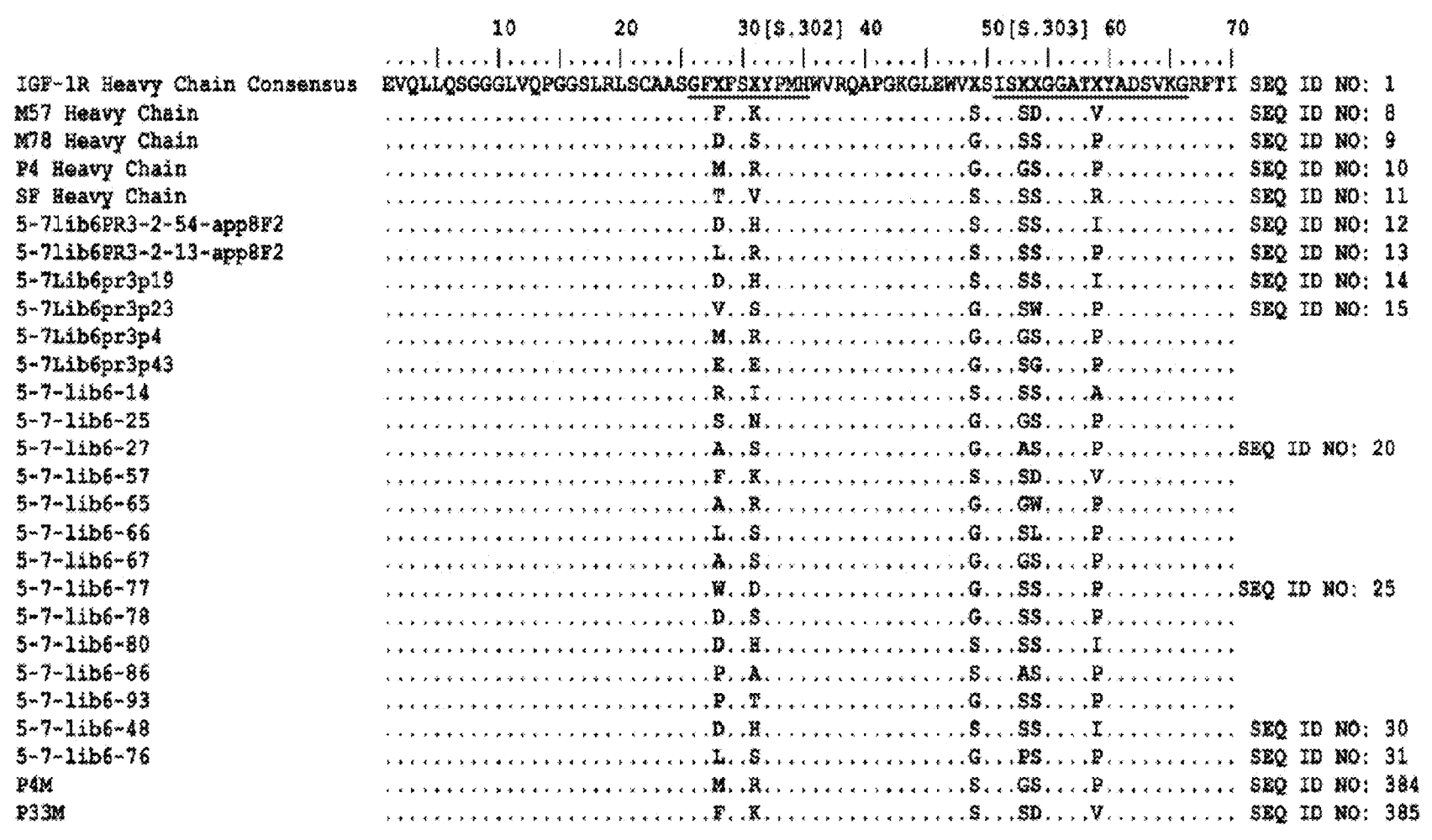
Figure 2A:
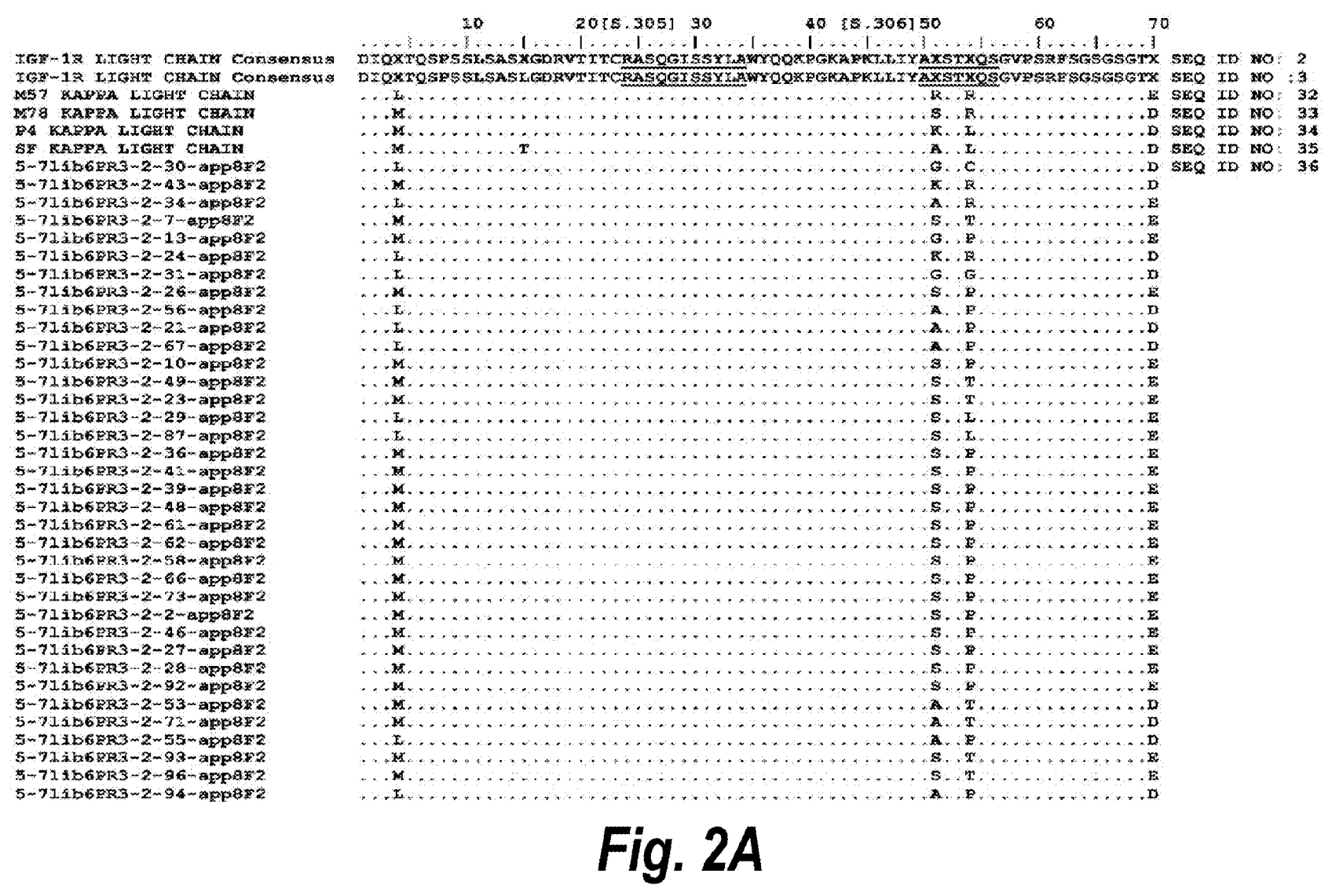
Figure 2B:
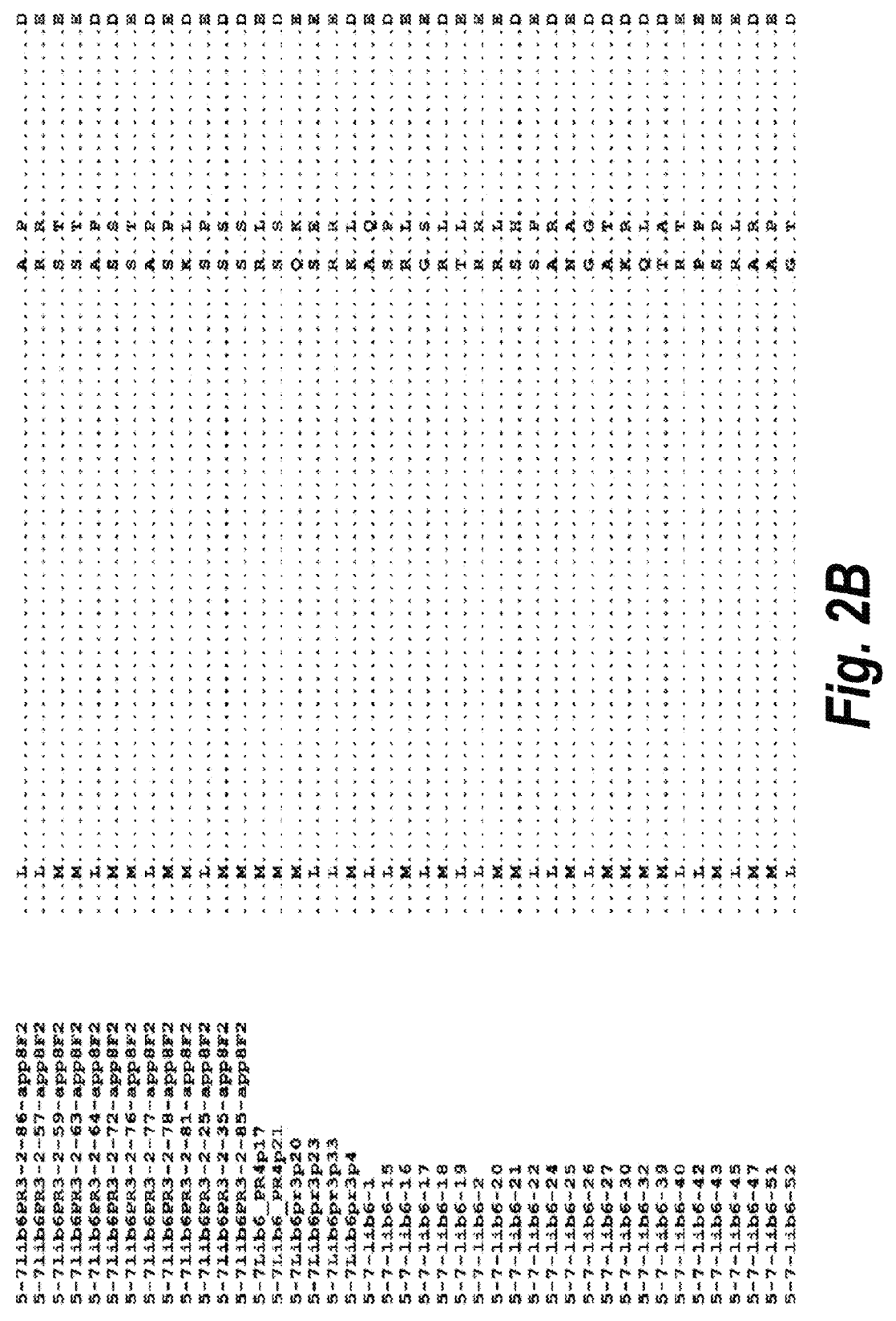
Figure 2C:
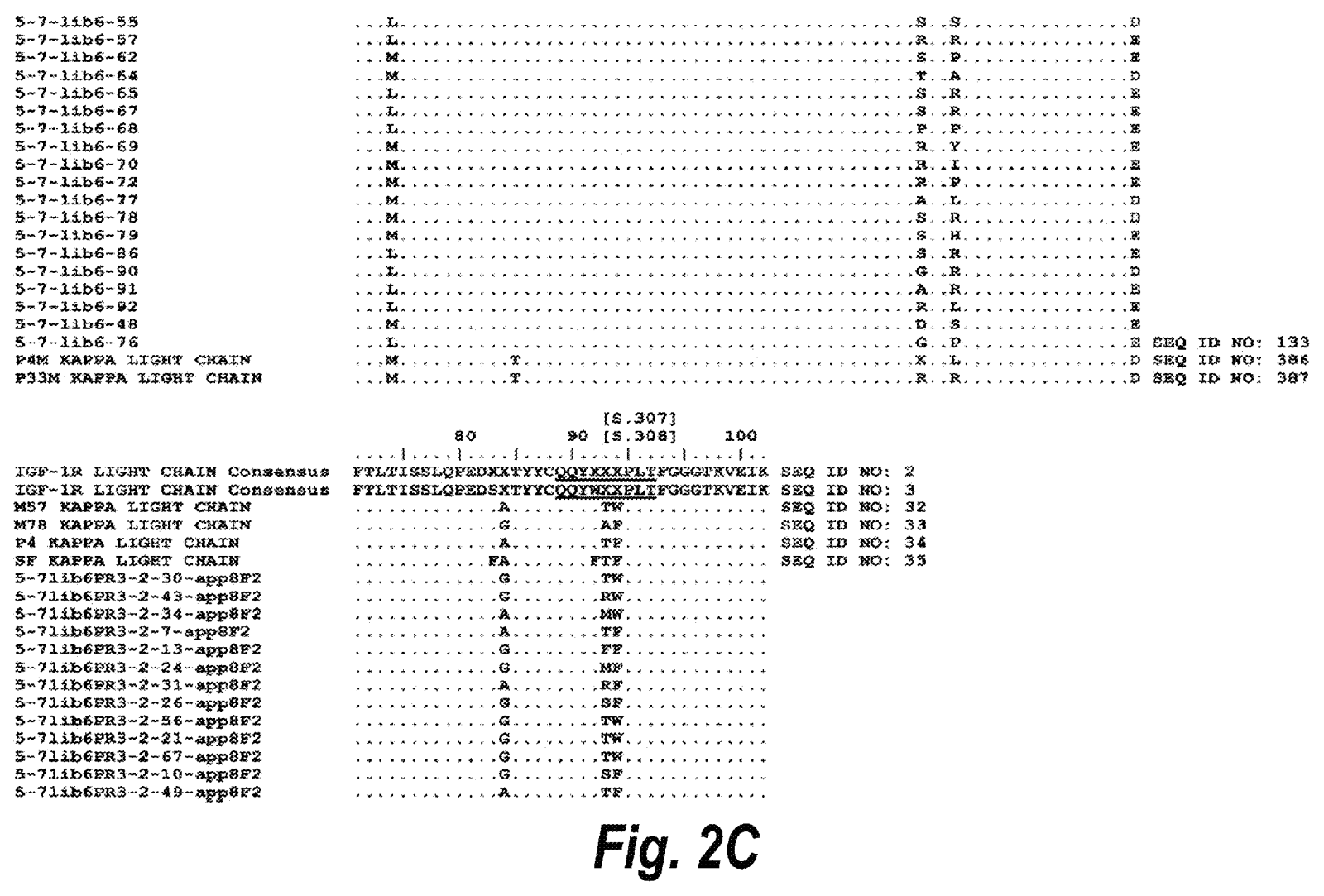
Figure 2D:
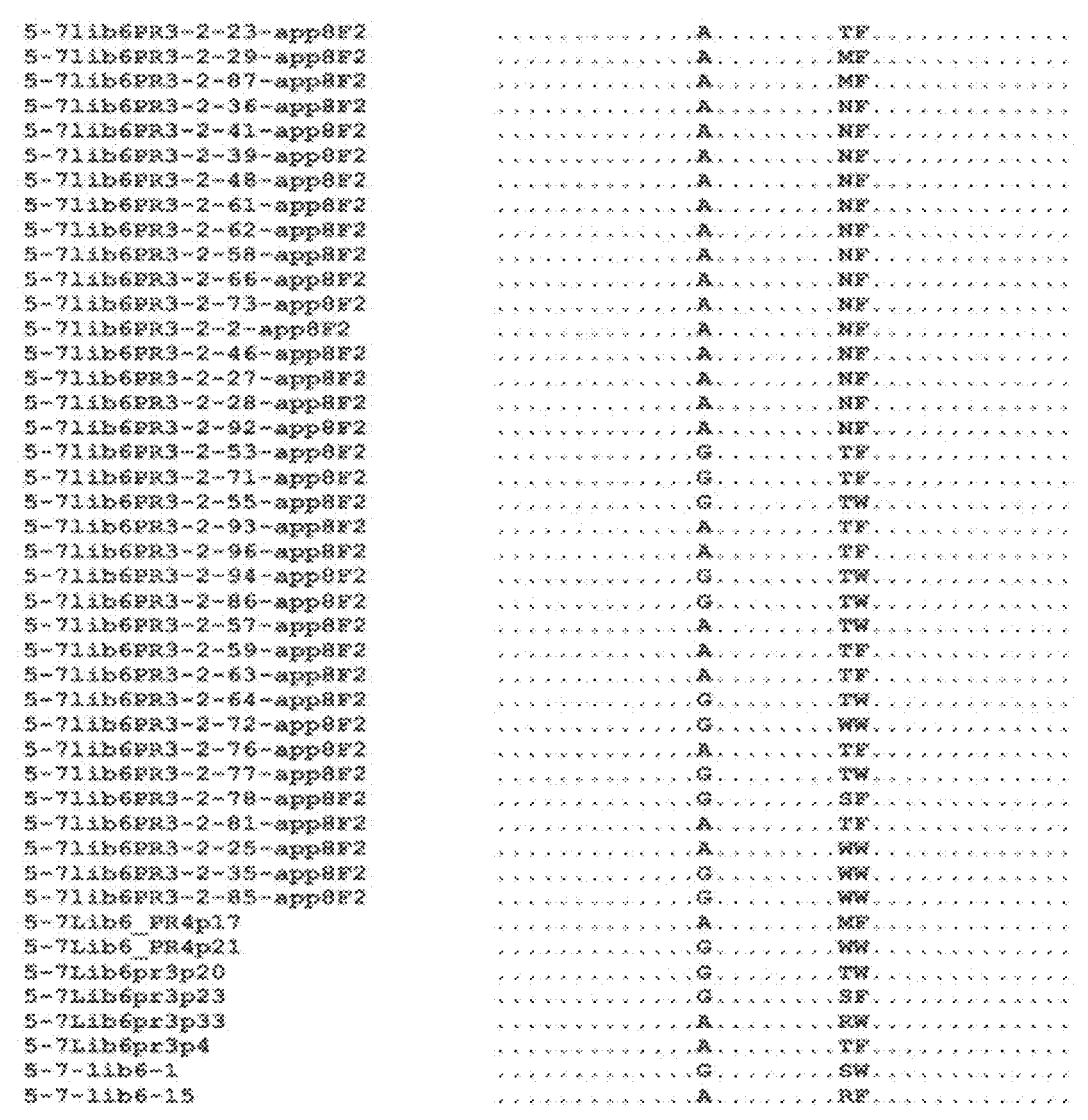

In certain embodiments, a PBA comprises an IGF-1R binding site comprising a VHCDR3 consisting of the consensus sequence of SEQ ID NO:304, and optionally a VHCDR1 and/or VHCDR2 consisting of the consensus sequences of SEQ ID NOs:302 and 303, respectively (see FIG. 1). In certain embodiments, the last (C-terminal) X aa of SEQ ID NO:304 is not I. A PBA may also comprise an anti-IGF-1R binding site comprising a VLCDR3 consisting of the consensus sequence of SEQ ID NO:307 or 308, and optionally either or both of a VLCDR1 and a VLCDR2 consisting of the sequences of SEQ ID NOs:305 and 306, respectively (see FIG. 2). In certain embodiments, a PBA comprises an anti-IGF-1R binding site comprising a VHCDR1, VHCDR2, VHCDR3, VLCDR1, VLCDR2 and VLCDR3 consisting of the consensus sequences of SEQ ID NOs:302, 303, 304, 305, 306, and 307 (or 308), respectively.

In certain embodiments, a PBA comprises an anti-ErbB3 binding site comprising a VHCDR3 consisting of the consensus sequence of SEQ ID NO:311, and optionally a VHCDR1 and/or a VHCDR2 consisting of the consensus sequences of SEQ ID NOs:309 and 310, respectively (see FIG. 3). A PBA may also comprise an anti-IGF-1R binding site comprising a VLCDR3 consisting of the consensus sequence of SEQ ID NO:314 or 315, and optionally a VLCDR1 and/or VLCDR2 consisting of the sequences of SEQ ID NOs:312 and 313, respectively (see FIG. 4). In certain embodiments, a PBA comprises an anti-IGF-1R binding site comprising a VHCDR1, VHCDR2, VHCDR3, VLCDR1, VLCDR2 and VLCDR3 consisting of the sequences of SEQ ID NOs:309, 310, 311, 312, 313, and 314 (or 315), respectively.

The sequences of SEQ ID NOs:302-315 are set forth below:

```
Anti-IGF-1R CDRs:
                                        (SEQ ID NO: 302)
VHCDR1 consensus sequence:    GFX1FSX2YPMH (SEQ ID NO: 303)
VHCDR2 consensus sequence:    ISX1X2GGATX3YADSVKG (SEQ ID NO: 304)
VHCDR3 consensus sequence:    DFYX1X2LTGNAFDX3

(SEQ ID NO: 305)
VLCDR1 sequence:              RASQGISSYLA (SEQ ID NO: 306)
VLCDR2 consensus sequence:    AX1STX2QS (SEQ ID NO: 307)
VLCDR3 consensus sequence:    QQYX1X2X3PLT
and (SEQ ID NO: 308)
                              QQYWX1X2PLT Anti-ErbB3 CDRs:

(SEQ ID NO: 309)
VHCDR1 sequence:              GFTFDDYAMH (SEQ ID NO: 310)
VHCDR2 consensus sequence:    ISWX1SGSX2GYADSVKG (SEQ ID NO: 311)
VHCDR3 consensus sequence:    DLGX1X2QWX3X4GFDY (SEQ ID NO: 312)
VLCDR1 sequence:              QGDSLRSYYAS (SEQ ID NO: 313)
VLCDR2 sequence:              GKNNRPS (SEQ ID NO: 314)
VLCDR3 consensus sequence:    X1SRDX2X3GX4X5WV
and (SEQ ID NO: 315)
                              X1SRDX2PGX3X4WV
```

Each aa "X" followed by a numeral is a variable aa, which independently represents any aa, such as any aa located at a corresponding position in FIGS. 1, 2, 3 or 4. Exemplary aas for X1-X2 of SEQ ID NO:302, X1-X2 of SEQ ID NO:303 and X1-X3 of SEQ ID NO:304 are provided at the corresponding positions in the aa sequences in FIG. 1. Exemplary aas for X1-X2 of SEQ ID NO:306, X1-X3 of SEQ ID NO:307 and X1-X2 of SEQ ID NO:308 are provided at the corresponding positions in the aa sequences in FIG. 2. Exemplary aas for X1-X2 of SEQ ID NO:310 and X1-X4 of SEQ ID NO:311 are provided at the corresponding positions in the aa sequences in FIG. 3. Exemplary aas for X1-X5 of SEQ ID NO:314 or X1-X4 of SEQ ID NO:315 are provided at the corresponding positions in the aa sequences in FIG. 4.

An exemplary PBA comprises an anti-IGF-1R binding site comprising a VHCDR1, VHCDR2, VHCDR3, VLCDR1, VLCDR2 and VLCDR3 consisting of the sequences of SEQ ID NOs:302, 303, 304, 305, 306, and 307 (or 308), respectively, and the anti-ErbB3 binding site comprising a VHCDR1, VHCDR2, VHCDR3, VLCDR1, VLCDR2 and VLCDR3 consisting of the sequences of SEQ ID NOs:309, 310, 311, 312, 313, and 314 (or 315), respectively.

Exemplary PBAs comprise one or more CDRs from one or more of the VRs provided in FIGS. 1-4. In certain embodiments, an anti-IGF-1R binding site comprises 1, 2 or 3 CDRs of one of the VH domains of FIG. 1 and/or 1, 2 or 3 CDRs of one of the VL domains of FIG. 2. For example, an anti-IGF-1R binding moiety may comprise CDR1, CDR2 and/or CDR3 from SEQ ID NO:11 and/or CDR1, CDR2 and/or CDR3 from SEQ ID NO:35 (CDRs of 16F). In certain embodiments, an anti-IGF-1R binding moiety comprises a combination of CDRs of FIGS. 1 and 2, with the proviso that (i.e., wherein) (i) the binding moiety is not that of 16F, or (ii) 1, 2, 3, 4, 5 or 6 of the CDRs of the anti-IGF-1R binding entities are not present in the anti-IGF-1R binding entity of 16F, or (iii) the VH or VL domains of the anti-IGF-1R binding entity is not identical to the corresponding VH or VL domains in 16F, respectively.

Exemplary PBAs comprise an anti-IGF-1R binding entity comprising a VH domain comprising the VHCDR1, VHCDR2 and VHCDR3 aa sequences of a sequence in FIG. 1, e.g., one of SEQ ID Nos:8, 9, 10 and 11 (the location of these CDRs is shown in FIG. 1). PBAs may also comprise an anti-IGF-1R binding entity comprising a VL domain comprising the VLCDR1, VLCDR2 and VLCDR3 aa sequences of one of SEQ ID Nos:32, 33, 34 and 35 (the location of these CDRs is shown in FIG. 2). In certain embodiments, PBAs comprise an anti-IGF-1R binding entity comprising a VH domain comprising the VHCDR1, VHCDR2 and VHCDR3 aa sequences of one of SEQ ID Nos:8, 9, 10 and 11 and a VL domain comprising the VLCDR1, VLCDR2 and VLCDR3 aa sequences of one of SEQ ID Nos:32, 33, 34 and 35. In particular embodiments, an anti-IGF-1R binding domain comprises a VH domain comprising the VHCDR1, VHCDR2 and VHCDR3 aa sequences of SEQ ID No:8 and a VL domain comprising the VLCDR1, VLCDR2 and VLCDR3 aa sequences of SEQ ID No:32. In particular embodiments, an anti-IGF-1R binding domain comprises a VH domain comprising the VHCDR1, VHCDR2 and VHCDR3 aa sequences of SEQ ID No:9 and a VL domain comprising the VLCDR1, VLCDR2 and VLCDR3 aa sequences of SEQ ID No:33. In particular embodiments, an anti-IGF-1R binding domain comprises a VH domain comprising the VHCDR1, VHCDR2 and VHCDR3 aa sequences of SEQ ID No:10 and a VL domain comprising the VLCDR1, VLCDR2 and VLCDR3 aa sequences of SEQ ID No:34. In particular embodiments, an anti-IGF-1R binding domain comprises a VH domain comprising the VHCDR1, VHCDR2 and VHCDR3 aa sequences of SEQ ID No:11 and a VL domain comprising the VLCDR1, VLCDR2 and VLCDR3 aa sequences of SEQ ID No:35. In particular embodiments, an anti-IGF-1R binding domain comprises a VH domain comprising the VHCDR1, VHCDR2 and VHCDR3 aa sequences of SEQ ID No:8 and a VL domain comprising the VLCDR1, VLCDR2 and VLCDR3 aa sequences of SEQ ID No:33. In particular embodiments, an anti-IGF-1R binding domain comprises a VH domain comprising the VHCDR1, VHCDR2 and VHCDR3 aa sequences of SEQ ID No:10 and a VL domain comprising the VLCDR1, VLCDR2 and VLCDR3 aa sequences of SEQ ID No:32.

In certain embodiments, an anti-ErbB3 binding site comprises 1, 2 or 3 CDRs of one of the VH domains of FIG. 3 and/or 1, 2 or 3 CDRs of one of the VL domains of FIG. 4. For example, an anti-ErbB3 binding moiety may comprise CDR1, CDR2 and/or CDR3 from SEQ ID NO:143 and/or CDR1, CDR2 and/or CDR3 from SEQ ID NO:175 (CDRs of 16F). In certain embodiments, an anti-ErbB3 binding moiety comprises a combination of CDRs of FIGS. 1 and 2, with the proviso that (i.e., wherein) (i) the binding moiety is not that of 16F, or (ii) 1, 2, 3, 4, 5 or 6 of the CDRs of the anti- anti-ErbB3 binding entities are not present in the anti-ErbB3 binding entity of 16F, or (iii) the VH or VL domains of the anti-ErbB3 binding entity is not identical to the corresponding VH or VL domains in 16F, respectively.

Exemplary PBAs comprise an anti-ErbB3 binding entity comprising a VH domain comprising the VHCDR1, VHCDR2 and VHCDR3 aa sequences of a sequence in FIG. 3, e.g., one of SEQ ID Nos:134-143 (the location of these CDRs are provided in FIG. 3). PBAs may also comprise an anti-ErbB3 binding entity comprising a VL domain comprising the VLCDR1, VLCDR2 and VLCDR3 aa sequences of one of SEQ ID Nos:166-175 (the location of these are provided in FIG. 4). In certain embodiments, PBAs comprise an anti-ErbB3 binding entity comprising a VH domain comprising the VHCDR1, VHCDR2 and VHCDR3 aa sequences of one of SEQ ID Nos:134-143 and a VL domain comprising the VLCDR1, VLCDR2 and VLCDR3 aa sequences of one of SEQ ID NOs:166-175. In particular embodiments, an anti-ErbB3 binding domain comprises a VH domain comprising the VHCDR1, VHCDR2 and VHCDR3 aa sequences of SEQ ID No:134 and a VL domain comprising the VLCDR1, VLCDR2 and VLCDR3 aa sequences of SEQ ID No:166. In particular embodiments, an anti-ErbB3 binding domain comprises a VH domain comprising the VHCDR1, VHCDR2 and VHCDR3 aa sequences of SEQ ID No:135 and a VL domain comprising the VLCDR1, VLCDR2 and VLCDR3 aa sequences of SEQ ID No:167. In particular embodiments, an anti-ErbB3 binding domain comprises a VH domain comprising the VHCDR1, VHCDR2 and VHCDR3 aa sequences of SEQ ID No:136 and a VL domain comprising the VLCDR1, VLCDR2 and VLCDR3 aa sequences of SEQ ID No:168. In particular embodiments, an anti-ErbB3 binding domain comprises a VH domain comprising the VHCDR1, VHCDR2 and VHCDR3 aa sequences of SEQ ID No:137 and a VL domain comprising the VLCDR1, VLCDR2 and VLCDR3 aa sequences of SEQ ID No:169. In particular embodiments, an anti-ErbB3 binding domain comprises a VH domain comprising the VHCDR1, VHCDR2 and VHCDR3 aa sequences of SEQ ID No:138 and a VL domain comprising the VLCDR1, VLCDR2 and VLCDR3 aa sequences of SEQ ID No:170. In particular embodiments, an anti-ErbB3 binding domain comprises a VH domain comprising the VHCDR1, VHCDR2 and VHCDR3 aa sequences of SEQ ID No:139 and a VL domain comprising the VLCDR1, VLCDR2 and VLCDR3 aa sequences of SEQ ID No:171. In particular embodiments, an anti-ErbB3 binding domain comprises a VH domain comprising the VHCDR1, VHCDR2 and VHCDR3 aa sequences of SEQ ID No:140 and a VL domain comprising the VLCDR1, VLCDR2 and VLCDR3 aa sequences of SEQ ID No:172. In particular embodiments, an anti-ErbB3 binding domain comprises a VH domain comprising the VHCDR1, VHCDR2 and VHCDR3 aa sequences of SEQ ID No:141 and a VL domain comprising the VLCDR1, VLCDR2 and VLCDR3 aa sequences of SEQ ID No:173. In particular embodiments, an anti-ErbB3 binding domain comprises a VH domain comprising the VHCDR1, VHCDR2 and VHCDR3 aa sequences of SEQ ID No:142 and a VL domain comprising the VLCDR1, VLCDR2 and VLCDR3 aa sequences of SEQ ID No:174. In particular embodiments, an anti-ErbB3 binding domain comprises a VH domain comprising the VHCDR1, VHCDR2 and VHCDR3 aa sequences of SEQ ID No:143 and a VL domain comprising the VLCDR1, VLCDR2 and VLCDR3 aa sequences of SEQ ID No:175. In particular embodiments, an anti-ErbB3 binding domain comprises a VH domain comprising the VHCDR1, VHCDR2 and VHCDR3 aa sequences of SEQ ID No:136 and a VL domain comprising the VLCDR1, VLCDR2 and VLCDR3 aa sequences of SEQ ID No:169.

Binding sites may also comprise one or more CDRs of the VRs of FIGS. 1-4, wherein 1, 2 or 3 aas have been changed, e.g., substituted, added or deleted, provided that the binding sites are still able to bind specifically to their target.

In certain embodiments, an anti-IGF-1R binding site comprises a VH domain comprising the following consensus sequence:

```
(SEQ ID NO: 1; the CDRs are underlined)
EVQLLQSGGGLVQPGGSLRLSCAASGFX1FSX2YPMHWVRQAPGKGLEWV
```

-continued

```
X3SISX4X5GGATX6YADSVKGRFTISRDNSKNTLYLQMNSLRX7EDTAV

YYCAKDFYX8X9LTGNAFDX10WGQGTX11VTVSS
```

This consensus sequence was obtained by aligning the VH sequences of 24 high affinity anti-IGF-1R binding sites. The alignment is shown in FIG. 1.

In certain embodiments, each of aas X1-X11 of SEQ ID NO:1 independently represents any aa. In other embodiments, each of aas X1-X11 of SEQ ID NO:1 independently represents any aa set forth at those positions in any of the sequences in FIG. 1. In one such embodiment, X1 is T, X2 is V, X3 is S, X4 is S, X5 is S, X6 is R, X7 is A, X8 is D, X9 is I, X10 is I and X11 is T (SF heavy chain 16F; SEQ ID NO:11). Exemplary IGF-1R VH sequences are set forth as SEQ ID NOs:8-31.

In certain embodiments, a VH domain of an anti-IGF-1R binding site comprises the consensus sequence of SEQ ID NO:1 with the proviso that (i.e., wherein) the sequence is not that of SF heavy chain 16F, e.g., by differing from it in at least one aa. In certain embodiments, a VH domain of an anti-IGF-1R binding site comprises the consensus sequence of SEQ ID NO:1 with the proviso that (i.e., wherein) X1 is not T, X2 is not V, X6 is not R, X8 is not D or X10 is not I. Exemplary anti-IGF-1R VH sequences are set forth as SEQ ID NOs:8-10 and 12-31.

In certain embodiments, an anti-IGF-1R binding site comprises a VL domain comprising the following consensus sequence:

```
                              (SEQ ID NO: 2; the CDRs are underlined)
DIQX1TQSPSSLSASX2GDRVTITCRASQGISSYLAWYQQKPGKAPKLLIYAX3STX4QSG

VPSRFSGSGSGTX5FTLTISSLQPEDX6X7TYYCQQYX8X9X10PLTFGGGTKVEIK
```

This consensus sequence was obtained by aligning the VL sequences of about 100 high affinity anti-IGF-1R binding sites. The alignment is shown in FIG. 2.

In certain embodiments, each of aas X1-X10 of SEQ ID NO:2 independently represents any aa. In other embodiments, each of aas X1-X10 of SEQ ID NO:2 independently represents any aa set forth at those positions in any of the sequences in FIG. 2. In one such embodiment, X1 is M, X2 is T, X3 is A, X4 is L, X5 is D, X6 is F, X7 is A, X8 is F, X9 is T and X10 is F (SF kappa light chain 16F; SEQ ID NO:35). Exemplary IGF-1R VL sequences are set forth as SEQ ID NOs:32-133.

In certain embodiments, a VL domain of an anti-IGF-1R binding site comprises the consensus sequence of SEQ ID NO:2, with the proviso that (i.e., wherein) the sequence is not that of SF light chain 16F, e.g., by differing from it in at least one aa. In certain embodiments, a VL domain of an anti-IGF-1R binding site comprises the consensus sequence of SEQ ID NO:2 with the proviso that (i.e., wherein) X2 is not T, X6 is not F or X8 is not F. When X2 is not T, X6 is not F and/or X8 is not F, X2 may be an L, X6 may be an F and/or X8 may be an F, as of the following consensus sequence:

In certain embodiments, a VL domain of an anti-IGF-1R binding site comprises the consensus sequence of SEQ ID NO:3, wherein each of aas X1-X7 of SEQ ID NO:3 independently represents any aa. In other embodiments, each of aas X1-X7 of SEQ ID NO:3 independently represents any aa set forth at those positions in any of the sequences in FIG. 2. Exemplary IGF-1R VL sequences are set forth as SEQ ID NOs:32-34 and 36-133.

In certain embodiments, an anti-ErbB3 binding site comprises a VH domain comprising the following consensus sequence:

```
                              (SEQ ID NO: 4; the CDRs are underlined)
X1VQLVX2SGGGLVQPGX3SLRLSCAASGFTFDDYAMHWVRQAPGKGLEW

VX4GISWX5SGSX6GYADSVKGRFTISRDNAKNSLYLQMNSLRX7EDTAX

8YYCARDLGX9X10QWX11X12GFDYWGQGTLVTVSS
```

This consensus sequence was obtained by aligning the VH sequences of 32 high affinity anti-IGF-1R binding sites. The alignment is shown in FIG. 3.

In certain embodiments, each of aas X1-X12 of SEQ ID NO:4 independently represents any aa. In other embodiments, each of aas X1-X12 of SEQ ID NO:4 independently represents any aa set forth at those positions in any of the sequences in FIG. 3. In one such embodiment, X1 is Q, X2 is Q, X3 is G, X4 is A, X5 is N, X6 is I, X7 is P, X8 is V, X9 is Y, X10 is N, X11 is V and X12 is E (C8 heavy chain 16F; SEQ ID NO:143). Exemplary ErbB3 VH sequences are set forth as SEQ ID NOs:134-165.

In certain embodiments, a VH domain of an anti-ErbB3 binding site comprises the consensus sequence of SEQ ID NO:4, with the proviso that (i.e., wherein) the sequence is not that of C8 heavy chain 16F, e.g., by differing from it in at least one aa. In certain embodiments, a VH domain of an anti-ErbB3 binding site comprises the consensus sequence of SEQ ID NO:4 with the proviso that (i.e., wherein) aa X7 is not P or X8 is not V. When X7 is not P and/or X8 is not V, X7 may be an A an/or X8 may be an L, as of the following consensus sequence:

```
                              (SEQ ID NO: 5; the CDRs are underlined)
X1VQLVX2SGGGLVQPGX3SLRLSCAASGFTFDDYAMHWVRQAPGKGLEW

VX4GISWX5SGSX6GYADSVKGRFTISRDNAKNSLYLQMNSLRAEDTALY

YCARDLGX7X8QWX9X10GFDYWGQGTLVTVSS.
```

In certain embodiments, a VH domain of an anti-ErbB3 binding site comprises the consensus sequence of SEQ ID NO:5, wherein each of aas X1-X10 of SEQ ID NO:5 independently represents any aa. In other embodiments, each of aas X1-X10 of SEQ ID NO:5 independently represents any aa

```
                              (SEQ ID NO: 3; the CDRs are underlined)
DIQX1TQSPSSLSASLGDRVTITCRASQGISSYLAWYQQKPGKAPKLLIYAX2STX3QSGV

PSRFSGSGSGTX4FTLTISSLQPEDSX5TYYCQQYWX6X7PLTFGGGTKVEIK
``` set forth at those positions in any of the sequences in FIG. 3. Exemplary ErbB3 VH sequences are set forth as SEQ ID NOs:134-142 and 144-165.

In certain embodiments, an anti-ErbB3 binding site comprises a VL domain comprising the following consensus sequence:

(SEQ ID NO: 6; the CDRs are underlined)
SX1ELTQDPAVSVALGQTVRITC<u>QGDSLRSYYAS</u>WYQQKPGQAPVLVIY<u>G KNNRPS</u>GIPDRFSGSX2SGNX3ASLTITGAQAEDEADYYC<u>X4SRDX5X6G X7X8WV</u>FGGGTKVTVX9G.

This consensus sequence was obtained by aligning the VL sequences of 35 high affinity anti-IGF-1R binding sites. The alignment is shown in FIG. 4.

In certain embodiments, each of aas X1-X9 of SEQ ID NO:6 independently represents any aa. In other embodiments, each of aas X1-X10 of SEQ ID NO:6 independently represents any aa set forth at those positions in any of the sequences in FIG. 4. In one embodiment, X1 is Y, X2 is T, X3 is S, X4 is N, X5 is S, X6 is S, X7 is N, X8 is H, and X9 is L (C8 lambda light chain 16F; SEQ ID NO:175). Exemplary ErbB3 VL sequences are set forth as SEQ ID NOs:166-200.

In certain embodiments, a VL domain of an anti-ErbB3 binding site comprises the consensus sequence of SEQ ID NO:6, with the proviso that (i.e., wherein) the sequence is not that of C8 lambda light chain 16F, e.g., by differing from it in at least one aa. In certain embodiments, a VL domain of an anti-ErbB3 binding site comprises the consensus sequence of SEQ ID NO:6 with the proviso that (i.e., wherein) X6 is not S. When X6 is not S, X6 may be P, as of the following consensus sequence:

(SEQ ID NO: 7; the CDRs are underlined)
SX1ELTQDPAVSVALGQTVRITC<u>QGDSLRSYYAS</u>WYQQKPGQAPVLVIY<u>G KNNRPS</u>GIPDRFSGSX2SGNX3ASLTITGAQAEDEADYYC<u>X4SRDX5PGX 6X7WV</u>FGGGTKVTVX8G.

In certain embodiments, a VL domain of an anti-ErbB3 binding site comprises the consensus sequence of SEQ ID NO:7, each of aas X1-X8 of SEQ ID NO:7 independently represents any aa. In other embodiments, each of aas X1-X8 of SEQ ID NO:7 independently represents any aa set forth at those positions in any of the sequences in FIG. 4. Exemplary ErbB3 VL sequences are set forth as SEQ ID NOs:166-174 and 176-200.

Exemplary anti-IGF-1R VH domains include the M57 VH domain (SEQ ID NO:8), M78 VH domain (SEQ ID NO:9), P4 VH domain (SEQ ID NO:10) and SF VH domain (SEQ ID NO:11). Exemplary anti-IGF-1R VL domains include the M57 VL domain (SEQ ID NO:32), M78 VL domain (SEQ ID NO:33), P4 VL domain (SEQ ID NO:34) and SF VL domain (SEQ ID NO:35).

Exemplary anti-ErbB3 VH domains include the B60 VH domain (SEQ ID NO:134), B72 VH domain (SEQ ID NO:135), M27 VH domain (SEQ ID NO:136), M7 VH domain (SEQ ID NO:137), P1 VH domain (SEQ ID NO:138), M27 VH domain (SEQ ID NO:139), B69 VH domain (SEQ ID NO:140), P6 VH domain (SEQ ID NO:141), M1.3 VH domain (SEQ ID NO:142), and C8 VH domain (SEQ ID NO:143). Exemplary anti-ErbB3 VL domains include the B60 VL domain (SEQ ID NO:166), B72 VL domain (SEQ ID NO:167), M27 VL domain (SEQ ID NO:168), M7 VL domain (SEQ ID NO:169), P1 VL domain (SEQ ID NO:170), M27 VL domain (SEQ ID NO:171), B69 VL domain (SEQ ID NO:172), P6 VH domain (SEQ ID NO:173), M1.3 VL domain (SEQ ID NO:174), and C8 VL domain (SEQ ID NO:175).

Binding sites may comprise a VH and a VL domain having the same module name (e.g., "M57," "M78" and "P4"), i.e., which are the VH and VL domains of an antibody of binding site thereof originally isolated, or they can be mixed and matched. For example, anti-IGF-1R binding moieties may comprise: (i) the VH domain of module M57 (SEQ ID NO:8) and the VL domain of module M57 (SEQ ID NO:32); the VH domain of module M78 (SEQ ID NO:9) and the VL domain of module M78 (SEQ ID NO:33); (iii) the VH domain of module P4 (SEQ ID NO:10) and the VL domain of module P4 (SEQ ID NO:34) or (iv) the VH domain of module SF (SEQ ID NO:11) and the VL domain of module SF (SEQ ID NO:35). An anti-ErbB3 binding moieties may comprise: (i) the VH domain of module B60 (SEQ ID NO:134) and the VL domain of module B60 (SEQ ID NO:166); (ii) the VH domain of module B72 (SEQ ID NO:135) and the VL domain of module B72 (SEQ ID NO:167); (iii) the VH domain of module M27 (SEQ ID NO:136) and the VL domain of module M27 (SEQ ID NO:168); (iv) the VH domain of module M7 (SEQ ID NO:137) and the VL domain of module M7 (SEQ ID NO:169); (v) the VH domain of module P1 (SEQ ID NO:138) and the VL domain of module P1 (SEQ ID NO:170); (vi) the VH domain of module M27 (SEQ ID NO:139) and the VL domain of module M27 (SEQ ID NO:171); (vii) the VH domain of module B69 (SEQ ID NO:140) and the VL domain of module B69 (SEQ ID NO:172); (viii) the VH domain of module P6 (SEQ ID NO:141) and the VL domain of module P6 (SEQ ID NO:173); (ix) the VH domain of module M1.3 (SEQ ID NO:142) and the VL domain of module M1.3 (SEQ ID NO:174); and (x) the VH domain of module C8 (SEQ ID NO:143) and the VL domain of module C8 (SEQ ID NO:175).

Binding moieties of PBAs may also comprise mixed and matched VH and VL domains, i.e., a binding moiety may comprise a VH domain from one module and a VL domain from another module. For example, an IGF-1R binding moiety may comprise the VH domain of module M57 (SEQ ID NO:8) and the VL domain of module M78 (SEQ ID NO:33) or the VH domain of module P4 (SEQ ID NO:10) and the VL domain of module M57 (SEQ ID NO:32). An anti-ErbB3 binding moiety may comprise the VH domain of module M27 (SEQ ID NO:136) and the VL domain of module M7 (SEQ ID NO:169; see, e.g., Example 7). Mixed chain binding moieties that bind with high affinity to their targets are preferred.

A PBA may also comprise aa sequences falling within more than one of the IGF-1R VH (SEQ ID NO:1), IGF-1R VL (SEQ ID NO:2), ErbB3 VH (SEQ ID NO:4) and ErbB3 VL (SEQ ID NO:6) consensus sequences described herein, provided that the PBA specifically binds to IGF-1R and ErbB3. For example, a PBA may comprise any of:

an IGF-1R VH domain comprising SEQ ID NO:1 and an IGF-1R VL domain comprising SEQ ID NO:2;
an IGF-1R VH domain comprising SEQ ID NO:1 and an ErbB3 VH domain comprising SEQ ID NO:4;
an IGF-1R VH domain comprising SEQ ID NO:1 and an ErbB3 VL domain comprising SEQ ID NO:6;
an IGF-1R VH domain comprising SEQ ID NO:1, an IGF-1R VL domain comprising SEQ ID NO:2, and an ErbB3 VH domain comprising SEQ ID NO:4;
an IGF-1R VH domain comprising SEQ ID NO:1, an IGF-1R VL domain comprising SEQ ID NO:2, and an ErbB3 VL domain comprising SEQ ID NO:6;

an IGF-1R VH domain comprising SEQ ID NO:1, an IGF-1R VL domain comprising SEQ ID NO:2, an ErbB3 VH domain comprising SEQ ID NO:4, and an ErbB3 VL domain comprising SEQ ID NO:6;

an IGF-1R VL domain comprising SEQ ID NO:2 and an ErbB3 VH domain comprising SEQ ID NO:4;

an IGF-1R VL domain comprising SEQ ID NO:2 and an ErbB3 VL domain comprising SEQ ID NO:6;

an IGF-1R VL domain comprising SEQ ID NO:2, an ErbB3 VH domain comprising SEQ ID NO:4, and an ErbB3 VL domain comprising SEQ ID NO:6; or an ErbB3 VH domain comprising SEQ ID NO:4 and an ErbB3 VL domain comprising SEQ ID NO:6;

wherein the variable aas are independently any aa, or wherein the variable aas are independently any of the aas set forth at the corresponding position for each of these consensus sequences of FIGS. 1-4, provided that the PBA binds specifically to IGF-1R and to ErbB3.

A PBA may also comprise aa sequences falling within more than one of the IGF-1R VH (SEQ ID NO:1), IGF-1R VL (SEQ ID NO:2), ErbB3 VH (SEQ ID NO:4) and ErbB3 VL (SEQ ID NO:6) consensus sequences described herein, provided that the PBA specifically binds to IGF-1R and ErbB3, with the proviso that (i.e., wherein) the PBA is not 16F. For example a PBA may comprise aa sequences falling within more than one of the IGF-1R VH (SEQ ID NO:1), IGF-1R VL (SEQ ID NO:3), ErbB3 VH (SEQ ID NO:5) and ErbB3 VL (SEQ ID NOs:7) consensus sequences described herein, provided that they specifically bind to IGF-1R and ErbB3. For example, a PBA may comprise:

an IGF-1R VH domain comprising SEQ ID NO:1 and an IGF-1R VL domain comprising SEQ ID NO:3;

an IGF-1R VH domain comprising SEQ ID NO:1 and an ErbB3 VH domain comprising SEQ ID NO:5;

an IGF-1R VH domain comprising SEQ ID NO:1 and an ErbB3 VL domain comprising SEQ ID NO:7;

an IGF-1R VH domain comprising SEQ ID NO:1, an IGF-1R VL domain comprising SEQ ID NO:3, and an ErbB3 VH domain comprising SEQ ID NO:5;

an IGF-1R VH domain comprising SEQ ID NO:1, an IGF-1R VL domain comprising SEQ ID NO:3, and an ErbB3 VL domain comprising SEQ ID NO:7;

an IGF-1R VH domain comprising SEQ ID NO:1, an IGF-1R VL domain comprising SEQ ID NO:3, an ErbB3 VH domain comprising SEQ ID NO:5, and an ErbB3 VL domain comprising SEQ ID NO:7;

an IGF-1R VL domain comprising SEQ ID NO:3 and an ErbB3 VH domain comprising SEQ ID NO:5;

an IGF-1R VL domain comprising SEQ ID NO:3 and an ErbB3 VL domain comprising SEQ ID NO:7;

an IGF-1R VL domain comprising SEQ ID NO:3, an ErbB3 VH domain comprising SEQ ID NO:5, and an ErbB3 VL domain comprising SEQ ID NO:7; or an ErbB3 VH domain comprising SEQ ID NO:5 and an ErbB3 VL domain comprising SEQ ID NO:7;

wherein the variable aas are independently any aa, or wherein the variable aas are independently any of the aas set forth at the corresponding position for each of these consensus sequences of FIGS. 1-4, provided that the PBA binds specifically to IGF-1R and to ErbB3.

Exemplary PBAs comprise an anti-IGF-1R binding entity comprising a VH domain comprising an aa sequence in FIG. 1, e.g., the aa sequence of one of SEQ ID Nos:8, 9, 10 and 11. PBAs may also comprise an anti-IGF-1R binding entity comprising a VL domain comprising an aa sequence in FIG. 2, e.g., the aa sequence of one of SEQ ID Nos:32, 33, 34 and 35. In certain embodiments, PBAs comprise an anti-IGF-1R binding entity comprising a VH domain comprising the aa sequence of one of SEQ ID Nos:8, 9, 10 and 11 and a VL domain comprising the aa sequence of one of SEQ ID Nos:32, 33, 34 and 35. In particular embodiments, an anti-IGF-1R binding domain comprises a VH domain comprising the aa sequence of SEQ ID No:8 and a VL domain comprising the aa sequence of SEQ ID No:32. In particular embodiments, an anti-IGF-1R binding domain comprises a VH domain comprising the aa sequence of SEQ ID No:9 and a VL domain comprising the aa sequence of SEQ ID No:33. In particular embodiments, an anti-IGF-1R binding domain comprises a VH domain comprising the aa sequence of SEQ ID No:10 and a VL domain comprising the aa sequence of SEQ ID No:34. In particular embodiments, an anti-IGF-1R binding domain comprises a VH domain comprising the aa sequence of SEQ ID No:11 and a VL domain comprising the aa sequence of SEQ ID No:35. In particular embodiments, an anti-IGF-1R binding domain comprises a VH domain comprising the aa sequence of SEQ ID No:8 and a VL domain comprising the aa sequence of SEQ ID No:33. In particular embodiments, an anti-IGF-1R binding domain comprises a VH domain comprising the aa sequence of SEQ ID No:10 and a VL domain comprising the aa sequence of SEQ ID No:32.

Exemplary PBAs comprise an anti-ErbB3 binding entity comprising a VH domain comprising the aa sequence of one of SEQ ID Nos:134-143. PBAs may also comprise an anti-ErbB3 binding entity comprising a VL domain comprising the aa sequence of one of SEQ ID Nos:166-175. In certain embodiments, PBAs comprise an anti-ErbB3 binding entity comprising a VH domain comprising the aa sequence of one of SEQ ID Nos:134-143 and a VL domain comprising the aa sequence of one of SEQ ID NOs:166-175. In particular embodiments, an anti-ErbB3 binding domain comprises a VH domain comprising the aa sequence of SEQ ID No:134 and a VL domain comprising the aa sequence of SEQ ID No:166. In particular embodiments, an anti-ErbB3 binding domain comprises a VH domain comprising the aa sequence of SEQ ID No:135 and a VL domain comprising the aa sequence of SEQ ID No:167. In particular embodiments, an anti-ErbB3 binding domain comprises a VH domain comprising the aa sequence of SEQ ID No:136 and a VL domain comprising the aa sequence of SEQ ID No:168. In particular embodiments, an anti-ErbB3 binding domain comprises a VH domain comprising the aa sequence of SEQ ID No:137 and a VL domain comprising the aa sequence of SEQ ID No:169. In particular embodiments, an anti-ErbB3 binding domain comprises a VH domain comprising the aa sequence of SEQ ID No:138 and a VL domain comprising the aa sequence of SEQ ID No:170. In particular embodiments, an anti-ErbB3 binding domain comprises a VH domain comprising the aa sequence of SEQ ID No:139 and a VL domain comprising the aa sequence of SEQ ID No:171. In particular embodiments, an anti-ErbB3 binding domain comprises a VH domain comprising the aa sequence of SEQ ID No:140 and a VL domain comprising the aa sequence of SEQ ID No:172. In particular embodiments, an anti-ErbB3 binding domain comprises a VH domain comprising the aa sequence of SEQ ID No:141 and a VL domain comprising the aa sequence of SEQ ID No:173. In particular embodiments, an anti-ErbB3 binding domain comprises a VH domain comprising the aa sequence of SEQ ID No:142 and a VL domain comprising the aa sequence of SEQ ID No:174. In particular embodiments, an anti-ErbB3 binding domain comprises a VH domain comprising the aa sequence of SEQ ID No:143 and a VL domain comprising the aa sequence of SEQ ID No:175. In particular embodiments, an anti-ErbB3 binding domain comprises a VH domain comprising the aa sequence of SEQ ID No:136 and a VL domain comprising the aa sequence of SEQ ID No:169.

In an exemplary embodiment, a PBA comprises a heavy chain comprising an immunoglobulin CR comprising, consisting essentially of, or consisting of the CH1 domain, hinge, CH2 domain and CH3 domain of an IgG1 (referred to as an "IgG1 CR"). Exemplary PBAs comprise an IgG1 CR and one or more of the following aa sequences: an IGF-1R VH domain comprising a consensus sequence of SEQ ID NO:1; an IGF-1R VL domain comprising a consensus sequence of SEQ ID NO:2; an ErbB3 VH domain comprising the consensus sequence of SEQ ID NO:4; and an ErbB3 VL domain comprising the consensus sequence of SEQ ID NO:6, and comprise PBAs comprising heavy and light chain aa sequences of FIGS. 5A, 5B, 7A and 7B.

Other exemplary PBAs comprise a heavy chain comprising an IgG1 CR and one or more of the following aa sequences: an IGF-1R VH domain comprising a consensus sequence of SEQ ID NO:1; an IGF-1R VL domain comprising a consensus sequence of SEQ ID NO:3; an ErbB3 VH domain comprising the consensus sequence of SEQ ID NO:5; and an ErbB3 VL domain comprising the consensus sequence of SEQ ID NO:7, and comprise PBAs comprising heavy and light chain aa sequences of FIGS. 5A and 5B, but excluding 16 heavy and light chains.

PBAs that comprise a carboxy terminus that would otherwise end with a lysine or an arginine may have their carboxy terminal aa clipped by a carboxypeptidase. To avoid that, it may be beneficial to add one or more aa at such a carboxy terminus. For example, when a protein would otherwise have "VEIK" at its carboxy terminus, 1, 2, 3, 4 5 or more aas may be added to the carboxy terminus to prevent removal of the lysine. In certain embodiments, these additional aa may originate from the CL domain. Thus, for example, in cases in which a PBA ends in an anti-IGF-1R VL sequence, which ends with "VEIK," the aa "RT" may be added at the carboxy terminus (see, e.g., P1-G1-P4; SEQ ID NO:268).

Anti-IGF-1R/ErbB3 PBAs may comprise a heavy chain comprising an aa sequence selected from the group consisting of heavy chain fusions (hybrids): SF-G1-C8 (i.e., 16F; SEQ ID NO:210); SF-G1-P1 (SEQ ID NO:212); SF-G1-M1.3 (SEQ ID NO:214); SF-G1-M27 (SEQ ID NO:216); SF-G1-P6 (SEQ ID NO:218); SF-G1-B69 (SEQ ID NO:220); P4-G1-C8 (SEQ ID NO:222); P4-G1-P1 (SEQ ID NO:224); P4-G1-M1.3 (SEQ ID NO:226); P4-G1-M27 (SEQ ID NO:228); P4-G1-P6 (SEQ ID NO:230); P4-G1-B69 (SEQ ID NO:232); M78-G1-C8 (SEQ ID NO:234); M78-G1-P1 (SEQ ID NO:236); M78-G1-M1.3 (SEQ ID NO:238); M78-G1-M27 (SEQ ID NO:240); M78-G1-P6 (SEQ ID NO:242); M78-G1-B69 (SEQ ID NO:244); M57-G1-C8 (SEQ ID NO:246); M57-G1-P1 (SEQ ID NO:248); M57-G1-M1.3 (SEQ ID NO:250); M57-G1-M27 (SEQ ID NO:252); M57-G1-P6 (SEQ ID NO:254) and M57-G1-B69 (SEQ ID NO:256). Anti-IGF-1R/ErbB3 PBAs may comprise a light chain comprising an aa sequence selected from the group consisting of Kappa light chains: SF (SEQ ID NO:202); P4 (SEQ ID NO:204); M78 (SEQ ID NO:206); and M57 (SEQ ID NO:208).

Anti-ErbB3/IGF-1R PBAs may comprise a heavy chain comprising an aa sequence selected from the group consisting of heavy chain fusions (hybrids): P1-G1-P4 (SEQ ID NO:268); P1-G1-M57 (SEQ ID NO:270); P1-G1-M78 (SEQ ID NO:272); M27-G1-P4 (SEQ ID NO:274); M27-G1-M57 (SEQ ID NO:276); M27-G1-M78 (SEQ ID NO:278); M7-G1-P4 (SEQ ID NO:280); M7-G1-M57 ((SEQ ID NO:282); M7-G1-M78 (SEQ ID NO:284); B72-G1-P4 (SEQ ID NO:286); B72-G1-M57 (SEQ ID NO:288); B72-G1-M78 (SEQ ID NO:290); B60-G1-P4 (SEQ ID NO:292); B60-G1-M57 (SEQ ID NO:294); B60-G1-M78 (SEQ ID NO:296); B60-G2-M78 (SEQ ID NO:355) and M7-G2-M78 (SEQ ID NO:357). Anti-ErbB3/IGF-1R PBAs may comprise a light chain comprising an aa sequence selected from the group consisting of lambda light chains: P1 (SEQ ID NO:258), M27 (SEQ ID NO:260), M7 (SEQ ID NO:262), B72 (SEQ ID NO:264), and B60 (SEQ ID NO:266).

A heavy chain may be paired with a light chain that comprises a VL domain of the same module as the VH domain of the heavy chain. However, heavy chains and light chains may also be mixed and matched, provided that the binding sites retain high affinity binding to their target.

Exemplary IGF-1R+ErbB3 PBAs Comprising IgG1 CRs

The names of 38 exemplary IGF-1R+ErbB3 PBAs comprising IgG1 CRs are here set forth below in Table 5, each of which names is followed by (in parentheses, in order) heavy chain SEQ ID NO and light chain SEQ ID NO. These IgG-like PBAs comprise two essentially identical heavy chains and two essentially identical light chains.

TABLE 5

| Exemplary IGF-1R + ErbB3 PBAs comprising IgG1 CRs | |
|---|---|
| SF-G1-P1 (SEQ ID NO: 212 and SEQ ID NO: 202) | SF-G1-M1.3 (SEQ ID NO: 214 and SEQ ID NO: 202) |
| SF-G1-M27 (SEQ ID NO: 216 and SEQ ID NO: 202) | SF-G1-P6 (SEQ ID NO: 218 and SEQ ID NO: 202) |
| SF-G1-B69 (SEQ ID NO: 220 and SEQ ID NO: 202) | P4-G1-C8 (SEQ ID NO: 222 and SEQ ID NO: 204) |
| P4-G1-P1 (SEQ ID NO: 224 and SEQ ID NO: 204) | P4-G1-M1.3 (SEQ ID NO: 226 and SEQ ID NO: 204) |
| P4-G1-M27 (SEQ ID NO: 228 and SEQ ID NO: 204) | P4-G1-P6 (SEQ ID NO: 230 and SEQ ID NO: 204) |
| P4-G1-B69 (SEQ ID NO: 232 and SEQ ID NO: 204) | M78-G1-C8 (SEQ ID NO: 234 and SEQ ID NO: 206) |
| M78-G1-P1 (SEQ ID NO: 236 and SEQ ID NO: 206) | M78-G1-M1.3 (SEQ ID NO: 238 and SEQ ID NO: 206) |
| M78-G1-M27 (SEQ ID NO: 240 and SEQ ID NO: 206) | M78-G1-P6 (SEQ ID NO: 242 and SEQ ID NO: 206) |
| M78-G1-B69 (SEQ ID NO: 244 and SEQ ID NO: 206) | M57-G1-C8 (SEQ ID NO: 246 and SEQ ID NO: 208) |
| M57-G1-P1 (SEQ ID NO: 248 and SEQ ID NO: 208) | M57-G1-M1.3 (SEQ ID NO: 250 and SEQ ID NO: 208) |

TABLE 5-continued

Exemplary IGF-1R + ErbB3 PBAs comprising IgG1 CRs

| | |
|---|---|
| M57-G1-M27 (SEQ ID NO: 252 and SEQ ID NO: 208) | M57-G1-P6 (SEQ ID NO: 254 and SEQ ID NO: 208) |
| M57-G1-B69 (SEQ ID NO: 256 and SEQ ID NO: 208) | P1-G1-P4 (SEQ ID NO: 268 and SEQ ID NO: 258) |
| P1-G1-M57 (SEQ ID NO: 270 and SEQ ID NO: 258) | P1-G1-M78 (SEQ ID NO: 272 and SEQ ID NO: 258) |
| M27-G1-P4 (SEQ ID NO: 274 and SEQ ID NO: 260) | M27-G1-M57 (SEQ ID NO: 276 and SEQ ID NO: 260) |
| M27-G1-M78 (SEQ ID NO: 278 and SEQ ID NO: 260) | M7-G1-P4 (SEQ ID NO: 280 and SEQ ID NO: 262) |
| M7-G1-M57 ((SEQ ID NO: 282 and SEQ ID NO: 262) | M7-G1-M78 (SEQ ID NO: 284 and SEQ ID NO: 262) |
| B72-G1-P4 (SEQ ID NO: 286 and SEQ ID NO: 264) | B72-G1-M57 (SEQ ID NO: 288 and SEQ ID NO: 264) |
| B72-G1-M78 (SEQ ID NO: 290 and SEQ ID NO: 264) | B60-G1-P4 (SEQ ID NO: 292 and SEQ ID NO: 266) |
| B60-G1-M57 (SEQ ID NO: 294 and SEQ ID NO: 266) | B60-G1-M78 (SEQ ID NO: 296 and SEQ ID NO: 266). |
| P4M-G1-M1.3 (SEQ ID NO: 376 and SEQ ID NO: 381) | P4M-G1-C8 (SEQ ID NO: 377 and SEQ ID NO: 381) |
| P33M-G1-M1.3 (SEQ ID NO: 378 and SEQ ID NO: 380) | P33M-G1-C8 (SEQ ID NO: 379 and SEQ ID NO: 380) |
| P4M-G1-P6L (SEQ ID NO: 389 and SEQ ID NO: 381) | P33M-G1-P6L (SEQ ID NO: 390 and SEQ ID NO: 380) |
| P1-G1-M76 (SEQ ID NO: 391 and SEQ ID NO: 258) | |

In an exemplary embodiment, a PBA comprises two identical heavy chains and two identical light chains, wherein the sequence of each of the heavy chains comprises, consists essentially of, or consists of SEQ ID NO:210 or 300, and wherein the sequence of each of the light chains domains comprise, consist essentially of, or consist of SEQ ID NO:202 or 298. PBAs may also comprise a heavy chain and/or a light chain that comprise an aa sequence that differs from SEQ ID NO:202 or 298 or SEQ ID NO:210 or 300, respectively, in exactly or in at most 1, 2, 3, 4, 5, 6, 7, 8, 9, 10, 15, 20, 25, 30, 50, 100, 200, or 300 aas, provided that the PBA has the desired biological characteristic(s), as further described herein. In one embodiment, a PBA comprises an aa sequence that differs from SEQ ID NO:210 or 300 by the addition of a lysine (K) at the end of the CH3 domain, i.e., creating the sequence . . . SLSLSPGKGGGGS . . . (SEQ ID NO:301). A PBA may also comprise an aa sequence that differs from SEQ ID NO:210 or 300 by comprising one or more of the following aa substitutions in the CH3 domain: S239D, N297Q, S298A, T299A, T299C, T299K, A330L, I332E, E333A, K334A, E356D, M358L, N434A, N343K (EU numbering; see FIG. 7A).

PBAs may also comprise two identical heavy chains and two identical light chains, wherein the sequence of each of the heavy chains and of each of the light chains comprises, consists essentially of, or consists of a sequence of FIG. 5A or 5B (i.e., any even SEQ ID-numbered sequence selected from SEQ ID NOs:202-296). PBAs may also comprise a heavy chain and/or a light chain comprising an aa sequence that differs from a sequence in FIG. 5A or 5B in exactly or in at most 1, 2, 3, 4, 5, 6, 7, 8, 9, 10, 15, 20, 25, 30, 50, 100, 200, or 300 aas, provided that the PBA has the desired biological characteristic(s), as further described herein. The differences in aas may be aa deletions, additions or substitutions (e.g., conservative substitutions). For example, a PBA may comprise an aa sequence that differs from an aa sequence of FIG. 5A or 5B, by the addition (or deletion) of a lysine at the end of a CH3 domain, and/or by comprising one or more of the following aa substitutions in the CH3 domain: S239D, N297Q, S298A, T299A, T299C, T299K, A330L, I332E, E333A, K334A, E356D, M358L, N434A, N343K (see FIG. 7A). One or more aa differences may be present in one or both of the two VH domains or in one or both of the two VL domains, e.g., in one or more CDR or in one or more framework region (FR). One or more aa differences may also be present in one or more of the immunoglobulin CR domains, e.g., in the CH1 domain, the CL domain, the hinge, the CH2 domain and/or the CH3 domain. Particular aa changes that may be made to an immunoglobulin CR, e.g., to change one or more characteristics of an immunoglobulin, are further described herein. Aa changes may also be present in the linker that connects the C-terminus of the CH3 domain to the N-terminus of the scFv and/or the scFv linker that connects the C-terminus of the VH domain of the scFv to the N-terminus of the VL domain of the scFv. Exemplary modifications that may be made to a connecting linker and an scFv linker are discussed further herein.

The following PBAs may also be used:

PBAs comprising a heavy chain and/or a light chain comprising an aa sequence that is at least 70%, 75%, 80%, 85%, 90%, 95%, 97%, 98% or 99% identical to the aa sequence of the heavy chain domain having SEQ ID NO:210 or 300 and/or the light chain domain having SEQ ID NO:202 or 298 (SEQ ID NOs of 16F), wherein the PBAs have the desired biological characteristic(s);

PBAs that are biosimilars or bioequivalents of a PBA consisting of two heavy chain domains, each of which consists of SEQ ID NO:210 or 300 and two light chain domains, each of which consists of SEQ ID NO:202 or 298;

PBAs comprising one or more domains, e.g., VH domain, VL domain, CDR domain, FR domain, CH1 domain, CL domain, hinge, CH2 domain, CH3 domain, linker, scFv VH domain, scFv linker, and scFv VL domain comprising an aa sequence that is at least 70%, 75%, 80%, 85%, 90%, 95%, 97%, 98% or 99% identical to the aa sequence of the corresponding domain(s) in SEQ ID NO:202, 210, 298 or 300;

PBAs comprising a heavy chain, domain and/or a light chain domain comprising an aa sequence that is at least 70%, 75%, 80%, 85%, 90%, 95%, 97%, 98% or 99% identical to the aa sequence of a heavy chain domain of FIG. 5A or 5B and/or a light chain domain of FIG. 5A or 5B, wherein the PBAs have the desired biological characteristic(s);

PBAs that are biosimilars or bioequivalents of a PBA consisting of two heavy chain domains, each of which comprises an aa sequence of FIG. 5A or 5B and two light chain domains, each of which comprises an aa sequence of FIG. 5A or 5B;

PBAs comprising one or more domains, e.g., VH domain, VL domain, CDR domain, FR domain, CH1 domain, CL domain, hinge domain, CH2 domain, CH3 domain, linker domain, scFv VH domain, scFv linker domain, and scFv VL domain comprising an aa sequence that is at least 70%, 75%, 80%, 85%, 90%, 95%, 97%, 98% or 99% identical to the aa sequence of the corresponding domain(s) in any one of the aa sequences of FIG. 5A or 5B.

In certain embodiments, in which a PBA comprises an aa sequence that differs from an aa sequence (such as an aa of FIGS. 5 or 6) set forth herein, the PBA is not 16F (i.e., does not comprise two heavy chains consisting of SEQ ID NO:210 and two light chains consisting of SEQ ID NO:202).

In certain embodiments, a PBA comprises two heavy-light chain pairs that associate with each other, wherein each heavy-light chain pair comprises an anti-IGF-1R binding site and an anti-ErbB3 binding site, and wherein the heavy-light chain pairs differ from each other. The heavy-light chain pairs may differ in one or more aas (e.g., in exactly or in at most 1, 2, 3, 4, 5, 6, 7, 8, 9, 10, 15, 20, 30, 40, 50, or up to 100 aas). For example, a first heavy-light chain pair may comprise a heavy chain CR and a second heavy-light chain pair may comprise a second heavy CR, wherein the first and the second heavy chain CRs have aa differences that favor their association with each other (e.g., "knobs and holes").

In certain embodiments, a polyvalent protein comprises more than four binding sites. For example, a hexavalent binding protein may comprise an IgG-(scFv)$_2$, i.e., a protein comprising two binding sites that are part of the IgG, one scFvs is attached to the C-terminus of the each of the CH3 domains of the IgG, and further comprising either another Fab or scFv, linked, e.g., through a linker, to the N-terminus of the IgG protein or to the C-terminus of each of the scFvs. An octavalent binding protein may comprise the same structure as a hexavalent binding protein, further comprising two additional binding sites.

In certain embodiments, a PBA may comprise one binding site that is derived from a binding protein or antibody that is known in the art, such as those further described herein. For example, a PBA may comprise one or more CDRs from an anti-IGF-1R antibody selected from the group consisting of CP-751,871; IMC-A12; ANTI-IGF-1R Ab# A; BIIB-G11; and C06, whose heavy and light chain aa sequences are of FIG. 37. For example, an anti-IGF-1R binding site for use in a PBA may comprise a VHCDR3 and/or VLCDR3 domain and optionally the VHCDR1, VLCDR1, VHCDR2 and/or VLCDR2 of any one of SEQ ID NOs:321-335. In certain embodiment, a PBA comprises an anti-IGF-1R binding site comprising 1, 2, 3, 4, 5, or 6 CDRs comprising an aa sequence that differs from the corresponding one of one of SEQ ID NOs:321-335 by 1, 2 or 3 aa additions, deletions or substitutions, provided that the binding site binds specifically to its target (antigen). In certain embodiments, a PBA comprises an anti-IGF-1R binding site comprising 1, 2, 3, 4, 5 or 6 CDRs comprising an aa sequence that is at least 70%, 80%, 90% or 95% identical or similar to the corresponding CDR of one of SEQ ID NOs:321-335. In certain embodiments, a PBA comprises a VH and/or a VL chain comprising an aa sequence of any one of SEQ ID NOs:321-335. In other embodiments, a PBA comprises a VH and/or VL chain that comprises an aa sequence that differs from any one of SEQ ID NOs:321-335 in at most 1, 2, 3, 4, 5, 10, 15, 20, 25 or 30 aa deletions, additions or substitutions, or which is at least 70%, 80%, 85%, 90%, 95%, 97%, 98%, or 99% identical to a sequence in SEQ ID NOs:321-335, provided that the binding site binds specifically to its target. In certain embodiments, a PBA comprises a binding site comprising a light chain and/or a heavy chain comprising an aa sequence of SEQ ID NOs:321-335, or which differs from it in at most 1, 2, 3, 4, 5, 10, 15, 20, 25, 30, 40, 50, 60, 70, 80, 90 or 100 aa deletions, additions or substitutions, or which is at least 70%, 80%, 85%, 90%, 95%, 97%, 98%, or 99% identical to a sequence in SEQ ID NOs: 321-335, provided that the binding site retains specific binding to its target. For example, a PBA may comprise (i) a VH domain and a VL domain; (ii) a heavy chain and a light chain; or (iii) an scFv comprising the VH and VL chains, from an antibody selected from the group of antibodies consisting of CP-751,871; IMC-A12; ANTI-IGF-1R Ab# A; BIIB-G11; and C06. Such a PBA may comprise an anti-ErbB3 binding site that is described herein.

A PBA may comprise one or more CDRs from a anti-ErbB3 antibody, e.g., anti-ErbB3 Ab# A; H3 (U.S. Pat. No. 7,332,580), MM Ab#3; MM Ab#14; MM Ab#17 or MM Ab#19, whose heavy and light chain aa sequences are of FIG. 38. For example, an anti-ErbB3 binding site for use in a PBA may comprise a VHCDR3 and/or VLCDR3 domain and optionally a VHCDR1, VLCDR1, VHCDR2 and/or VLCDR2 of any one of SEQ ID NOs:336-353. In certain embodiment, a PBA comprises an anti-ErbB3 binding site comprising 1, 2, 3, 4, 5, or 6 CDRs comprising an aa sequence that differs from the corresponding one of one of SEQ ID NOs:336-353 by 1, 2 or 3 aa additions, deletions or substitutions, provided that the binding site binds specifically to its target. In certain embodiments, a PBA comprises an anti-ErbB3 binding site comprising 1, 2, 3, 4, 5 or 6 CDRS comprising an aa sequence that is at least 70%, 80%, 90% or 95% identical or similar to the corresponding CDR of one of SEQ ID NOs:336-353. In certain embodiments, a PBA comprises a VH and/or a VL chain comprising an aa sequence of any one of SEQ ID NOs:336-353. In other embodiments, a PBA comprises a VH and/or VL chain that comprises an aa sequence that differs from any one of SEQ ID NOs:336-353 in at most 1, 2, 3, 4, 5, 10, 15, 20, 25 or 30 aa deletions, additions or substitutions, provided that the binding site retains specific binding to its target, or which is at least 70%, 80%, 85%, 90%, 95%, 97%, 98%, or 99% identical to a sequence in SEQ ID NOs:336-353. In certain embodiments, a PBA comprises a binding site comprising a light chain and/or a heavy chain comprising an aa sequence of SEQ ID NOs:336-353, or which differs from it in at most 1, 2, 3, 4, 5, 10, 15, 20, 25, 30, 40, 50, 60, 70, 80, 90 or 100 aa deletions, additions or substitutions, or which is at least 70%, 80%, 85%, 90%, 95%, 97%, 98%, or 99% identical to a sequence in SEQ ID NOs: 336-353, provided that the binding site binds specifically to its target. For example, a PBA may comprise (i) a VH domain and a VL domain; (ii) a heavy chain and a light chain; or (iii) an scFv comprising the VH and VL chains, from an antibody selected from the group of antibodies consisting of anti-ErbB3 Ab# A; H3 (U.S. Pat. No. 7,332,585), MM Ab#3; MM Ab#14; MM Ab#17 and MM Ab#19. Yet other anti-ErbB3 binding sites (or portions thereof, such as CDRs, V domains or chains) that may be used are those from the anti-ErbB3 antibodies 1B4C3 (cat #sc-23865, Santa Cruz Biotechnology) and 2D1D12 (U3 Pharma AG), both of which are described in, e.g., US Pat Pub No. 20040197332 and are produced by hybridoma cell lines DSM ACC 2527 or DSM ACC 2517 (deposited at DSMZ), AV-203 (SEQ ID NO:190 (heavy chain) and SEQ ID NO:206 (light chain) in WO 2011/136911, Aveo Pharmaceuticals) or 8B8 (produced by ATCC® hybridoma #HB12070™, and described in WO 1997/035885) those described in U.S. Pat. No. 7,846,440, the monoclonal antibody Mab 205.10.2 (SEQ ID NO:8 (heavy chain) and SEQ ID NO:10 (light chain) in US Pat Pub No. 20110171222, Roche Glycart), the murine anti-ErbB3 antibody described in US Pat Pub No. 20100310557 (Trellis Biosciences) or a bispecific anti-ErbB3/anti-EGFR antibody (e.g., SEQ ID NO:14 (heavy chain) and SEQ ID NO:13 (light chain), Genentech). Such PBAs may comprise an anti-IGF-1R binding site that is described herein.

PBAs may also comprise a binding site that binds to the same epitope on human IGF-1R or human ErbB3 as the binding moieties provided herein, e.g., it may compete with binding moieties having sequences as of FIGS. 5A and 5B. Binding moieties encompassed herein may also compete for binding to antigen with a binding moiety described herein, e.g., it may compete with binding moieties having sequences as of FIGS. 5A and 5B. A binding protein comprising a binding moiety that competes with a binding moiety described herein for binding to a target antigen or epitope may be a binding moiety that is capable of displacing the binding moiety described herein when added to an ELISA before or after the binding moiety described herein.

In certain embodiments, PBAs provided herein do not include PBAs that are of PCT/US2010/052712, in other embodiments PBAs provided herein do not include variable domains of PBAs that are of PCT/US2010/052712.

Exemplary immunoglobulin CRs

In certain embodiments, a PBA comprises two heavy chains, wherein each comprises an immunoglobulin CR. The polyvalent binding domain may also comprise two light chains, wherein each light chain comprises a CL domain. The immunoglobulin CR may be from a human Ig, e.g., a human IgG1, IgG2, IgG3 or IgG4, or from more than one isotype of immunoglobulin. For example, one domain may be from an IgG1, and other domains may be from other IgG isotypes. In certain embodiments, a portion of one domain is from one IgG isotype and the other domains are from another IgG isotype.

A heavy chain immunoglobulin CR, which may comprise one or more of a CH1 domain, a hinge, a CH2 domain, a CH3 domain, and a CH4 domain, may comprise or consist of an aa sequence that is at least 70%, 75%, 80%, 85%, 90%, 95%, 97%, 98% or 99% identical to a heavy chain immunoglobulin CR in a naturally occurring or wild type constant domain of a particular IgG isotype, e.g., IgG1, or a CR of one of the aa sequences set forth herein. A CL domain may also comprise or consist of a an aa sequence that is at least 70%, 75%, 80%, 85%, 90%, 95%, 97%, 98% or 99% identical to a CL domain in a naturally occurring or wild type kappa or lambda light chain or a CL domain in one of the aa sequences set forth herein.

A heavy chain immunoglobulin CR, which may comprise one or more of a CH1 domain, a hinge, a CH2 domain, a CH3 domain, and a CH4 domain, may comprise exactly or at most 1, 2, 3, 4, 5, 6, 7, 8, 9, 10, 11-15, 16-20, 21-25, 26-30, 31-35, 36-40, 41-45, 46-50, 50-100 or more aa substitutions, additions and/or deletions relative to the same heavy chain immunoglobulin CR in a naturally occurring or wild type constant domain of a particular IgG isotype, e.g., IgG1, or relative to a heavy chain immunoglobulin CR set forth herein, e.g., in FIGS. 5-7. A CL domain may comprise exactly or at most 1, 2, 3, 4, 5, 6, 7, 8, 9, 10, 11-15, 16-20, 21-25, 26-30, 31-35, 36-40, 41-45, 46-50, 50-100 or more aa substitutions, additions and/or deletions relative to a CL domain in a naturally occurring or wild type kappa or lambda light chain or a CL domain set forth herein.

Each domain of a CR, i.e., a CH1 domain, hinge, CH2 domain, CH3 domain and CL domain may comprise one or more (e.g., 1, 2, 3, 4, 5, 6, 7, 8, 9, 10 or more) aa substitutions, additions and/or deletions relative to a naturally occurring or wild-type constant domain of a particular IgG isotype, e.g., IgG1, or a constant domain set forth herein. Each domain of a CR, i.e., a CH1 domain, hinge, CH2 domain, CH3 domain and CL domain may comprise an aa sequence that is at least 70%, 75%, 80%, 85%, 90%, 95%, 97%, 98% or 99% identical to the same domain in a naturally occurring or wild type constant domain of a particular IgG isotype, e.g., IgG1, or a domain set forth herein.

Aa substitutions, additions or deletions may be spatially positioned relative to each other by an interval of at least 1 aa position or more, for example, at least 2, 3, 4, 5, 6, 7, 8, 9, or 10 aa positions or more. In certain embodiments, engineered aas are spatially positioned apart from each other by an interval of at least 5, 10, 15, 20, or 25 aa positions or more.

In certain embodiments, PBAs comprise a CR, e.g., an Fc region or domain thereof, comprising an aa sequence set forth herein. In certain embodiments, PBAs comprise a CR, e.g., an Fc region or domain thereof, comprising an aa sequence set forth herein, wherein 1 or more aas have been deleted, added or substituted, or comprising an aa sequence that is at least about 80%, 90%, 95%, 97%, 98% or 99% identical to a sequence set forth herein. For example, aas 356 and 358 in the CH3 domain of SEQ ID NO:300 or any other aa sequence in FIGS. 5 and 6 may be substituted, e.g., E356D and M358L, to mirror the wild type IgG1 CH3 sequence. Any constant domain variant that represents any haplotype is also encompassed herein.

The effect of certain aa changes to a constant domain can be determined as further described herein or as known in the art.

Replacements of aa residues in the Fc portion to alter antibody effector function are known in the art (U.S. Pat. Nos. 5,648,260 and 5,624,821). The Fc portion of an antibody mediates several important effector functions e.g., cytokine induction, ADCC, phagocytosis, complement dependent cytotoxicity (CDC) and half-life/clearance rate of antibody and antigen-antibody complexes. In some cases these effector functions are desirable for a therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one aa residue is replaced in the CR of the antibody, for example the Fc region of the antibody, such that effector functions of the antibody are altered. The dimerization of two identical heavy chains of an immunoglobulin is mediated by the dimerization of CH3 domains and is stabilized by the disulfide bonds within the hinge region.

In one embodiment, a PBA retains one or more of, and preferably all of the following attributes: antibody-dependent cellular cytotoxicity (ADCC) and antibody-dependent cellular phagocytosis (ADCP) that in humans are determined by interactions with activating FcγRI, FcγRIIa/c, FcγRIIIa and inhibitory FcγRIIb receptors; complement-dependent cytotoxicity (CDC) that is triggered by antibody binding to the components of the complement system; and long half-life that is mediated via active recycling by the neonatal Fc receptor (FcRn). All of these functions can be tuned to optimize the effectiveness of an anti-cancer therapy and are preferably retained in a PBA.

Certain aa modifications may be made to an immunoglobulin CR to reduce or increase the naturally biological activities of the constant domains, such as those set forth above. Accordingly, in certain embodiments, a constant immunoglobulin region comprises an aa substitution, deletion or addition at an aa position that is within the "15 Angstrom Contact Zone" of an Fc. The 15 Angstrom Zone includes residues located at EU positions 243 to 261, 275 to 280, 282-293, 302 to 319, 336 to 348, 367, 369, 372 to 389, 391, 393, 408, and 424-440 of a full-length, wild-type Fc moiety.

In certain embodiments, a binding protein (e.g., a PBA, an anti-IgG-1R binding site and an anti-ErbB3 binding site) comprises an aa change (e.g., an aa substitution, addition or deletion) in an Fc domain that alters one or more antigen-independent effector functions of the domain, e.g., the circulating half-life of a protein comprising the domain. Exemplary antibodies exhibit either increased or decreased binding to FcRn when compared to antibodies lacking such aa changes and, therefore, have an increased or decreased half-life in serum, respectively. Antibodies comprising Fc variants with improved affinity for FcRn are anticipated to have longer serum half-lives, whereas those comprising Fc variants with decreased FcRn binding affinity are expected to have shorter half-lives. In one embodiment, a binding protein with altered FcRn binding comprises at least one Fc domain having one or more aa changes within the "FcRn binding loop" of an Fc domain. The FcRn binding loop is comprised of aa residues 280-299 (EU) of a wild-type, full-length, Fc. In other embodiments, a binding protein having altered FcRn binding affinity comprises at least one Fc domain having one or more aa substitutions within the 15 Å FcRn "contact zone." The term 15 Å FcRn "contact zone" includes residues at the following positions of a wild-type, full-length Fc domain: 243-261, 275-280, 282-293, 302-319, 336-348, 367, 369, 372-389, 391, 393, 408, 424, 425-440 (EU). In certain embodiments, a binding protein having altered FcRn binding affinity comprises at least one Fc domain (e.g, one or two Fc moieties) having one or more aa changes at an aa position corresponding to any one of the following EU positions: 256, 277-281, 283-288, 303-309, 313, 338, 342, 376, 381, 384, 385, 387, 434 (e.g., N434A or N434K), and 438. Exemplary aa changes that alter FcRn binding activity are disclosed in International PCT Publication No. WO05/047327.

In some embodiments, a binding protein comprises an Fc variant comprising an aa change that alters the antigen-dependent effector functions of the polypeptide, in particular ADCC or complement activation, e.g., as compared to a wild type Fc region. In exemplary embodiment, said antibodies exhibit altered binding to an Fc gamma receptor (e.g., CD16). Such antibodies exhibit either increased or decreased binding to FcγRs when compared to wild type polypeptides and, therefore, mediate enhanced or reduced effector function, respectively. Fc variants with improved affinity for FcγRs are anticipated to enhance effector function, and such proteins may have useful applications in methods of treating mammals where target molecule destruction is desired, e.g., in tumor therapy. In contrast, Fc variants with decreased FcγR binding affinity are expected to reduce effector function. In one embodiment, a binding protein comprises at least one altered antigen-dependent effector function selected from the group consisting of opsonization, phagocytosis, complement dependent cytotoxicity, antigen-dependent cellular cytotoxicity (ADCC), or effector cell modulation as compared to a binding protein comprising a wild type Fc region.

In one embodiment a binding protein exhibits altered binding to an activating FcγR (e.g., FcγRI, FcγRIIa, or FcγRIIIa). In another embodiment, a binding protein exhibits altered binding affinity to an inhibitory FcγR (e.g., FcγRIIb). In other embodiments, a binding protein having increased FcγR binding affinity (e.g., increased FcγRIIIa binding affinity) comprises at least one Fc domain having an aa change at an aa position corresponding to one or more of the following positions: 239, 268, 298, 332, 334, and 378 (EU). In certain embodiments, a binding protein having decreased FcγR binding affinity (e.g., decreased FcγRI, FcγRII, or FcγRIIIa binding affinity) comprises at least one Fc domain having an aa substitution at an aa position corresponding to one or more of the following positions: 234, 236, 239, 241, 251, 252, 261, 265, 268, 293, 294, 296, 298, 299, 301, 326, 328, 332, 334, 338, 376, 378, and 435 (EU).

In certain embodiments, a binding protein having increased complement binding affinity (e.g., increased C1q binding affinity) comprises an Fc domain having an aa change at an aa position corresponding to one or more of the following positions: 251, 334, 378, and 435 (EU). In certain embodiments, a binding protein having decreased complement binding affinity (e.g., decreased C1q binding affinity) comprises an Fc domain having an aa substitution at an aa position corresponding to one or more of the following positions: 239, 294, 296, 301, 328, 333, and 376 (EU). Exemplary aa changes that alter FcγR or complement binding activity are disclosed in International PCT Publication No. WO05/063815. In certain embodiments, a binding protein may comprise one or more of the following specific Fc region substitutions: S239D, S239E, M252T, H268D, H268E, I332D, I332E, N434A, and N434K (EU).

A binding protein may also comprise an aa substitution that alters the glycosylation of the binding protein. For example, an immunoglobulin CR of a binding protein may comprise an Fc domain having a mutation leading to reduced glycosylation (e.g., N- or O-linked glycosylation) or may comprise an altered glycoform of the wild-type Fc domain (e.g., a low fucose or fucose-free glycan). An "engineered glycoform" refers to a carbohydrate composition that is covalently attached to an Fc region, wherein said carbohydrate composition differs chemically from that of a parent Fc region. Engineered glycoforms may be useful for a variety of purposes, including but not limited to enhancing or reducing effector function. Engineered glycoforms may be generated by a variety of methods known in the art (U.S. Pat. No. 6,602,684; US Pat Pub No. 2010-0255013; US Pat Pub No. 20030003097; WO 00/61739A1; WO 01/29246A1; WO 02/31140A1; WO 02/30954A1); (Potelligent™ technology (Biowa, Inc., Princeton, N.J.); and GlycoMAb™ glycosylation engineering technology (Glycart Biotechnology AG, Zurich, Switzerland). Many of these techniques are based on controlling the level of fucosylated and/or bisecting oligosaccharides that are covalently attached to the Fc region, for example by expressing an Fc polypeptide in various organisms or cell lines, engineered or otherwise (for example Lec-13 CHO cells or rat hybridoma YB2/0 cells), by regulating enzymes involved in the glycosylation pathway (for example FUT8 [a1, 6-fucosyltransferase] and/or (31-4-N-acetylglucosaminyl, transferase III [GnTIII]), or by modifying carbohydrate (s) after the Fc polypeptide has been expressed.

In exemplary embodiments, an aa change, e.g., an aa substitution results in an Fc region comprising reduced glycosylation of the N-linked glycan normally found at aa position 297 (EU). The Fc region may also comprise a low fucose or fucose free glycan at aa position 297 (EU). In certain embodiments, the binding protein has an aa substitution near or within a glycosylation motif, for example, an N-linked glycosylation motif that contains the aa sequence NXT or NXS. In a particular embodiment, a binding protein comprises an aa substitution at an aa position corresponding to 297 or 299 of Fc (EU). Exemplary aa substitutions that reduce or alter glycosylation are disclosed in International PCT Publication No. WO05/018572 and US Pat Pub No. 20070111281.

In other embodiments, a binding protein comprises at least one Fc domain having one or more engineered cysteine residues or analog thereof that are located at the solvent-exposed surface. Preferably the engineered cysteine residue or analog thereof does not interfere with the desired biological activity of the binding protein. For example, it may be desirable that the alteration does not interfere with the ability of the Fc to bind to Fc receptors (e.g., FcγRI, FcγRII, or FcγRIII) or complement proteins (e.g., C1q), or to trigger immune effector function (e.g., antibody-dependent cytotoxicity (ADCC), phagocytosis, or complement-dependent cytotoxicity (CDCC)). In certain embodiments, the antibodies comprise an Fc domain comprising at least one engineered free cysteine residue or analog thereof that is substantially free of disulfide bonding with a second cysteine residue. The antibodies may comprise an Fc domain having engineered cysteine residues or analogs thereof at one or more of the following positions in the CH3 domain: 349-371, 390, 392, 394-423, 441-446, and 446b (EU). The antibodies may comprise an Fc variant having engineered cysteine residues or analogs thereof at any one of the following positions: 350, 355, 359, 360, 361, 389, 413, 415, 418, 422, 441, 443, and EU position 446b.

Desired effector functions may also be obtained by choosing an Fc from a particular immunoglobulin class or subclass, or by combining particular regions from particular immoglobulin classes or subclasses, e.g., IgG1, IgG2, etc. For example, since ADCC and CDC (through binding of IgG to the FcγRs and C1q, respectively) is mediated by residues located in the hinge and CH2 domain, and since IgG4 essentially lacks effector functions, an effectorless Fc may be constructed by combining the hinge and CH2 domain of IgG4 and the CH3 domain of IgG1. Fab-arm exchange in proteins comprising an IgG4 hinge may be reduced by the substitution S228P in the hinge.

An immunoglobulin CR may also be modified by making changes, e.g., in the CH3 domains, referred to in the art as "knobs-into-holes" and described, e.g., in U.S. Pat. No. 7,183,076). In this strategy, the Fc portions of two heavy chains are engineered to give one a protruding "knob," and the other a complementary "hole," thereby favoring the association of the heavy chains.

Exemplary Linkers

Linkers may be used to connect two domains or regions together, e.g., a variable domain to a constant domain, a variable domain to a variable domain and a constant domain to a constant domain. A linker connecting the VH domain of an scFv to the VL domain of the scFv is referred to as an "scFv linker." A linker connecting an scFv to a constant domain, e.g., a CH3 domain, is referred to as a "connecting linker."

Linkers are preferably of sufficient length to allow the proper folding of the domains or regions being connected. For example, a linker may be 1-10, 10-20, 20-30, 30-40, 40-50, 50-60, 60-70, 70-80, 80-90 or at least 90-100 aas long.

In certain embodiments, a linker is biologically inert, e.g., mostly incapable of inducing a biological response, e.g., an immune response.

A polypeptide linker may comprise or consist of a Gly-Ser linker. A "Gly-Ser linker" refers to a peptide that consists of glycine and serine residues. An exemplary Gly-Ser linker comprises an aa sequence having the formula $(Gly_4Ser)_n$ (SEQ ID NO:395), wherein n is a positive integer (e.g., 1, 2, 3, 4, 5, 6, 7, 8, 9, 10, 11, 12, 13, 14, 15, 16, 17, 18, 19, or 20). For example, in certain embodiments, a connecting linker comprises or consists of $(Gly_4Ser)_3$ (SEQ ID NO:396) or $(Gly_4Ser)_4$ (SEQ ID NO:397) or $(Gly_4Ser)_5$ (SEQ ID NO:398). In certain embodiments, an scFv linker comprises or consists of $(Gly_4Ser)_3$ or $(Gly_4Ser)_4$ (SEQ ID NO:397) or $(Gly_4Ser)_5$ (SEQ ID NO:398). In addition to a $(Gly_4Ser)_n$ sequence, a linker may also comprise one or more additional aas located N-terminally or C-terminally to the $(Gly_4Ser)_n$ sequence. For example, an scFv linker may comprise 3 aas, e.g., AST located N-terminally to the $(Gly_4Ser)_n$ (SEQ ID NO:399) sequence (see, e.g., in the heavy chain sequence of 16F of FIG. 7 and as SEQ ID NO:300. In that sequence, the scFv linker consists of the aa sequence AST $(Gly_4Ser)_3$ (SEQ ID NO:400).

Exemplary Biological Characteristics of PBAs

In certain embodiments, a PBA inhibits growth of tumor cells in vitro. As shown in Example 3(C) and in FIGS. 16 and 17, an anti-ErbB3/anti-IGF-1R IgG2(scfv)2 PBA inhibited proliferation of two different tumor cell lines in 2D cultures, whereas either binding site alone did not significantly inhibit their proliferation. Thus, in certain embodiments, PBAs inhibit in vitro tumor cell proliferation more potently (e.g., as measured by percent inhibition over a 6 day culture, e.g., the culture described in Example 3(C)), than either of the binding sites alone. Proliferation by a PBA may be inhibited by at least 10%, 20%, 30%, 40%, 50%, 60%, 70%, 80%, 90% or more, relative to proliferation of the cells in the absence of the PBA.

In certain embodiments, a PBA inhibits in vivo tumor cell proliferation. As shown in Example 3(D) and FIGS. 18A to 20B, an anti-ErbB3/anti-IGF-1R IgG2(scfv)2 PBA inhibited proliferation of two different tumor cell lines in a mouse model of cancer to a higher degree relative to that by the individual binding sites. Thus, in certain embodiments, PBAs inhibit in vivo tumor cell proliferation more potently (e.g., as measured by comparing tumor size at the end of the experiment, e.g., that described in Example 3(D)), than either of the binding sites alone. Tumor growth by a PBA may be inhibited by at least 10%, 20%, 30%, 40%, 50%, 60%, 70%, 80%, 90% or more, relative to tumor growth in the absence of the PBA.

"Compared to either of the binding sites alone" refers to a comparison with one or the other of the binding sites of a PBA, when that binding site comprises the same VRs as the those of the binding site in the PBA, and is, e.g., in the form of an antibody, e.g., an IgG1 antibody (as shown, e.g., in the Examples).

In certain embodiments, a PBA inhibits signal transduction mediated through either or both of IGF-1R and ErbB3. As shown in Examples 3(B), 4 and 5(C), various PBAs inhibited signal transduction through IGF-1R and ErbB3, as measured by inhibition of phosphorylation of IGF-1R, ErbB3 and AKT. The examples show that PBAs can inhibit signal transduction to a similar or higher degree or extent relative to a prior art anti-IGF-1R antibody (ANTI-IGF-1R Ab# A—SEQ ID NO:327 for the HC and SEQ ID NO:328 for the LC) or anti-ErbB3 antibody (anti-ErbB3 Ab# A—SEQ ID NO:336 for HC and 337 for LC) or a combination thereof. In certain embodiments, the percent reduction of levels of any one or combination of two or three of pIGF-1R, pErbB3 and pAKT is comparable to (e.g., within 1%, 5%, or 10%), greater than (e.g., by 10%, 20%, 30%, 40% or 50%) or less than (e.g., by 10%, 20%, 30%, 40%, 50%) that of ANTI-IGF-1R Ab# A or anti-ErbB3 Ab# A, or a combination thereof. In some embodiments, the inhibition of phosphorylation (e.g., % inhibition) at the end of the experiment, e.g., as described in the Examples, is comparable to, or higher, or lower than, that of a prior art anti-IGF-1R or anti-ErbB3 antibody or combination thereof. In certain embodiments, a PBA inhibits phosphorylation of IGF-1R, ErbB3 and/or AKT by at least 30%, 40%, 50%, 60%, 70%, 80%, 85%, 90%, 95%, 98%, 99% or more, relative to phosphorylation in the absence of the PBA, when determined, e.g., at the end of the experiment, e.g., as of the Examples. Preferred PBAs inhibit IGF-1R and/or ErbB3 signal transduction, e.g., measured by inhibition of phosphorylation of IGF-1R and ErbB3, nearly completely, e.g., by at least 90%, 91%, 92%, 93%, 94%, 95%, 96%, 97%, 98%, 99% or 99.5%.

Inhibition of a) ligand mediated phosphorylation of ErbB3, and b) IGF-1- or IGF-2-mediated phosphorylation of IGF-1R respectively can be demonstrated by the ability of a PBA to reproducibly decrease the level of phosphorylation of a) ErbB3 induced by an ErbB family ligand (e.g., heregulin), b) IGF-1R induced by an IGF-1R ligand (i.e., IGF-1 or IGF-2), or c) AKT induced by an IGF-1R ligand or an ErbB3 ligand, each relative to the phosphorylation in control cells that are not contacted with the PBA. The cell which expresses ErbB3 and/or IGF-1R can be a naturally occurring cell or a cell of a cell line or can be recombinantly produced by introducing nucleic acid encoding ErbB3 and/or IGF-1R into a host cell. In one embodiment, the PBA inhibits an ErbB family ligand mediated phosphorylation of ErbB3 by at least about 5%, 10%, 20%, 30%, 40%, 50%, 60%, 70%, 80%, 85%, 90%, 91%, 92%, 93%, 94%, 95%, 96%, 97%, 98% or 99%, or more, as determined, for example, by Western blotting followed by probing with an anti-phosphotyrosine antibody as described in the Examples infra. In another embodiment, the PBA inhibits IGF-1- or IGF-2-mediated phosphorylation of IGF-1R by at least about 5%, 10%, 20%, 30%, 40%, 50%, 60%, 70%, 80%, 85%, 90%, 91%, 92%, 93%, 94%, 95%, 96%, 97%, 98% or 99%, or more, as determined, for example, by Western blotting followed by probing with an anti-phosphotyrosine antibody as described in the Examples infra.

PBAs may suppress heregulin-induced pAKT signaling in a cell, e.g., a cancer cel, by at least 10%, 20%, 30%, 40%, 50%, 60%, 70%, 75%, 80%, 85%, 90%, 95%, 97%, 98%, 99% or 100%. PBAs may suppress IGF-1-induced pAKT signaling in a cell, e.g., a cancer cell, by at least 10%, 20%, 30%, 40%, 50%, 60%, 70%, 75%, 80%, 85%, 90%, 95%, 97%, 98%, 99% or 100%. PBAs may suppress insulin-induced pAKT signaling in a cell, e.g., a cancer cell, by at least 10%, 20%, 30%, 40%, 50%, 60%, 70%, 75%, 80%, 85%, 90%, 95%, 97%, 98%, 99% or 100%. PBAs may suppress the IGF-2-induced pAKT signaling in a cell, e.g., a cancer cell, by at least 10%, 20%, 30%, 40%, 50%, 60%, 70%, 75%, 80%, 85%, 90%, 95%%, 97%, 98%, 99% or 100%. Inhibition of pAKT signaling may be determined as further described herein, e.g., in the Examples.

PBAs may inhibit ligand induced phosphorylation of IGF-1R by at least 70% or 80%, ligand induced phosphorylation of ErbB3 by at least 70% or 80% and optionally ligand induced phosphorylation of AKT by at least 30% or 40%. PBAs may also inhibit ligand induced phosphorylation of IGF-1R by at least 85%, ligand induced phosphorylation of ErbB3 by at least 85% and optionally ligand induced phosphorylation of AKT by at least 75%. In certain embodiments, PBAs inhibit ligand induced phosphorylation of IGF-1R by at least 50% and ligand induced phosphorylation of ErbB3 by at least 90%, and optionally ligand induced phosphorylation of AKT by at least 30%, 40%, 50%, 60%, 70%, 80% or 90%.

PBAs may also be defined by the EC50 (i.e. the concentration of PBA at which 50% of maximum inhibition is obtained) of their inhibition of phosphorylation of one or more of IGF-1R, ErbB3 and AKT, which EC50s may be determined as further described herein. For example, PBAs disclosed herein may inhibit phosphorylation of IGF-1R with an EC50 of $10^{-9}$ M, $10^{-10}$ M or lower. They may inhibit phosphorylation of ErbB3 with an EC50 of $10^{-9}$ M, $10^{-10}$ M or lower. They may inhibit phosphorylation of AKT with an EC50 of $10^{-7}$ M, $10^{-8}$ M, $10^{-9}$ M, $10^{-10}$ M or lower. Some PBAs disclosed herein inhibit phosphorylation of IGF-1R by at least 80% or 85% with an EC50 of $10^{-9}$ M, $10^{-10}$ M or lower; inhibit phosphorylation of ErbB3 by at least 80% or 85% with an EC50 of $10^{-9}$ M, $10^{-10}$ M or lower; and optionally inhibit phosphorylation of AKT by at least 55% or 65% or 75% with an EC50 of $10^{-7}$ M, $10^{-8}$ M, $10^{-9}$ M, $10^{-10}$ M or lower. In some cases, essentially complete blockage of either or both of phosphorylation of IGF-1R and phosphorylation of ErbB3 will be obtainable with a PBA herein disclosed.

In some embodiments, a PBA provided herein binds to cells expressing one or both of its targets (i.e., antigen(s) bound by the PBA) with an EC50 of from about 0.02 nM or lower to about 10 nM, or with a Kd of about $10^{-8}$ M, $10^{-9}$ M, $10^{-10}$ M, $10^{-11}$ M, or $10^{-12}$ M, or lower; each as measured, e.g., by flow cytometry using such cells expressing one or both of the target antigens of the PBA. In other embodiments, a PBA provided herein binds to its target(s) either or both of human IGF-1R and human ErbB3) with a Kd of about $10^{-6}$ M, $10^{-7}$ M, $10^{-8}$ M, $10^{-9}$ M, $10^{-10}$ M, $10^{-11}$ M, or $10^{-12}$ M, or lower, as measured, e.g., by or by surface Plasmon resonance using a BIAcore apparatus. For example, an anti-ErbB3/anti-IGF-1R IgG2 (scfv)$_2$ PBA provided herein was shown to bind to ADRr and MCF7 cells with a Kd of 2.5 and 2.1 nM, respectively (see Example 3A). Example 5(A) shows that several other PBAs bind to BxPC-3 cells with an EC50 of about 2-5 nM. Example 5(B) shows that several PBAs bind to ErbB3 with an EC50 of about 0.2-0.4 nM. Other PBAs bind to BxPC-3 cells with an EC50 ranging from 0.02 nM (e.g., P4-G1-P6) to about 1 nM or to about 2 nM.

In certain embodiments, a PBA binds an antigen (e.g., either ErbB3 or IGF-1R) with a dissociation constant (Kd) of 50 nM or less (i.e., a binding affinity at least as high as that indicated by a Kd of 50 nM) (e.g., a Kd of 40 nM or 30 nM or 20 nM or 10 nM or 1 nm, or 100 pM or 10 pM or 1 pM or less). In a particular embodiment, a PBA binds an antigen (either ErbB3 or IGF-1R) with Kd of 8 nM or better (e.g., 7 nM, 6 nM, 5 nM, 4 nM, 2 nM, 1.5 nM, 1.4 nM, 1.3 nM, 1 nM, 100 pM, 10 pM or 1 pM or 0.1 pM or less). In other embodiments, the binding protein, binding moiety or binding site binds an antigen (e.g., ErbB3 or IGF-1R) with a dissociation constant (Kd) of less than approximately $10^{-7}$ M, such as less than about $10^{-8}$ M, $10^{-9}$ M, $10^{-10}$ M, $10^{-11}$ M or $10^{-12}$ M or even lower, and binds to the antigen with an affinity that is at least an order of magnitude higher (i.e., a Kd value that is at least ten-fold lower) than its binding affinity for to a non-specific antigen (e.g., KLH, BSA, or casein).

PBAs may inhibit the binding of a ligand to IGF-1R and/or ErbB3. For example, PBAs may inhibit binding of a ligand to IGF-1R and/or ErbB3 by at least 70%, 80%, 90%, 95%, 97%, 98% or 99%, as measured, e.g., on cells or in vitro. Certain PBAs inhibit the level of binding of a ligand to IGF-1R and/or ErbB3 when the ligand is added before or after the PBA.

In certain embodiments, a solution comprising PBAs at a concentration of 0.3, 0.5, 1, 2, 3, 4, 5, 6, 7, 8, 9, 10, 11, 12, 13, 14, 15 mg/ml or more (or ranges of concentrations between any of these two numbers) comprises more than 70%, 75%, 80%, 85%, 90%, 95%, 96%, 97%, 98% or 99% of PBAs in unaggregated form (referred to in this context as monomers) as determined e.g., by Size Exclusion Chromatography (SEC) e.g., following, a stability test as described below. The percentage of monomers may be determined in a solution after one of the following stability tests: a) incubation at 4° C. for 1, 2, 3, 4, 5, or 6 days, or 1, 2, 3 or more weeks; b) incubation at room temperature for 1, 2, 3, 4, 5, or 6 days, or 1, 2, 3 or more weeks; c) incubation at 37° C. for 1, 2, 3, 4, 5, or 6 days, or 1, 2, 3 or more weeks; d) 1, 2, 3, 4 or 5 cycles of freeze/thaw, and e) agitation, e.g., gentle agitation on the orbital shaker at room temperature, e.g., for 1, 2, 3, 4, 5 or more hours.

In certain embodiments, a PBA exhibits a stability after 1, 2, 3, 4 or 5 days of incubation in serum at 37° C. of at least 70%, 75%, 80%, 85%, 90%, 95%, 96%, 97%, 98% or 99%, relative to its stability at day 0, where the stability of a protein is determined by, e.g., measuring its ability to bind to one or more of its target antigens after incubation, as determined, e.g., by ELISA (see, e.g., Example 7).

In certain embodiments, a PBA has a melting temperature (Tm) as determined e.g., by Differential Scanning Fluorimetry (DSF) of at least 50° C., 55° C., 60° C., 61° C., 62° C., 63° C., 64° C., 65° C., 66° C., 67° C., 68° C., 69° C. or 70° C., as described in the Examples.

In certain embodiments, a PBA effectively inhibits signal transduction through IGF-1R and/or ErbB3 when the ligand is present at a high or a low concentration. In certain embodiments, a PBA suppresses basal signaling, e.g., suppresses the level of pAKT present in a cell in the absence of ligand induction. A PBA may also down-regulate IGF-1R and/or ErbB3, e.g., phosphorylated and/or non phosphorylated receptor, on the cell surface, e.g., by at least 10%, 20%, 30%, 40%, 50%, 60%, 70%, 80%, 90% or more, relative to a cell that was not exposed to the PBA. A PBA may also inhibit insulin signaling in cells, e.g., by at least 10%, 20%, 30%, 40%, 50%, 60%, 70%, 80%, 90% or more, relative to a cell that was not exposed to the PBA.

PBAs may have a stability of at least 1, 2, 3, 4, 5, 6, 7, 8, 9, or 10 days in mouse or human serum. PBAs may have a half-life of at least 10 hours, 20 hours, 30 hours, 40 hours, 45 hours, 50 hours, 60 hours, 70 hours, 80 hours, 90 hours, 100 hours, 110 hours, 115 hours or more in Cynomolgus monkeys when injected with either 5 or 25 mg/kg mice. In certain embodiments, a PBA, has a half-life that is statistically significantly longer, e.g., at least 10%, 20%, 30%, 40%, 50%, 60%, 70%, 80%, 90%, 95%, 100% (i.e., 2 fold), 150% or 200% longer, in an organism that is a mouse or a cynomolgus monkey than the half-life of another polyvalent bispecific ab in the same organism, binding to the same epitopes, wherein the orientation of antigen binding specificities is reversed between of the fab and of the scfv.

In certain embodiments, a PBA represses the protein level of mTOR or the level of phospho-mTOR, or reduces or inhibits mTOR activation (i.e., reduces levels of pmTOR), e.g., by about 50%, by 2 fold, 3 fold, 4 fold, 5 fold, or more relative to a monospecific anti-IGF-1R antibody that binds to the same epitope on IGF-1R as the PBA does.

PBAs may have a combination of two or more of the characteristics set forth herein. For example, a PBA may inhibit ligand induced phosphorylation of IGF-1R by at least 80% and ligand induced phosphorylation of ErbB3 by at least 80%, and also exhibit one or more of the following characteristics: (i) a Tm, as determined by DSF, of at least 60° C. or 65° C.; (ii) be at least 80%, 90% or 95% monomeric in PBS at 10 mg/mL after 5 days at room temperature; (iii) and have a stability of at least 70%, 80% or 90% after 5 days of incubation in serum at 37° C. In certain embodiments, PBAs have a Tm of at least 60° C. and serum stability of at least 90%. In other embodiments, PBAs (i) inhibit growth of tumor cells, e.g., by at least 10%, 20%, 30%, 40%, 50%, 60%, 70%, 80%, 90% or more; (ii) inhibit signal transduction mediated through IGF-1R and/or ErbB3, e.g., by at least 70%, 80%, 90% or more, (iii) are stable, e.g., be at least 80% monomeric in a solution after 1, 2, 3, 4, 5 or more days at 4° C., room temperature or 37° C., and/or (iv) have a Tm, as determined by DSF, of at least 50° C., 55° C., 60° C., 65° C. or more; e.g., to a similar extent or more efficiently or potently than either binding entity alone or together.

Standard assays may be used for determining the biological activity and characteristics of anti-IGF-1R+anti-ErbB3 PBAs. Exemplary assays for the following tests are provided herein in the Examples: (a) assays for determining the binding affinity or Kd of a binding site to its target; (b) assays for determining the ability of a binding protein to bind to a cell; (c) essays for determining the ability of a binding protein to inhibit signal transduction, by measuring inhibition of phosphorylation of IGF-1R, ErbB3 or AKT; (d) assays for determining the ability of a PBA to inhibit cell proliferation in vitro; (e) assays for determining the effect of a PBA on tumor cells in vivo; and (f) assays for determining the stability of a PBA.

Monovalent and Divalent Monospecific Antibodies

Further provided herein are monovalent and bivalent monospecific antibodies that are either 1) bivalent IgG antibodies that can be made by co-expression of at least one nucleic acid molecule encoding the heavy chain and at least one nucleic acid molecule, which may be the same as or different from the molecule encoding the heavy chain, that encodes the light chain of the antibody, or 2) monovalent single chain Fv (scFv) antibodies that can be made by expression of at least one nucleic acid molecule encoding the scFv; each expressed in a suitable expression system, as described herein, including commercially available expression systems and others that are well known in the art. These antibodies may be monoclonal.

Anti-IGF-1R Antibodies

Provided herein are anti-IGF-1R antibodies, which bind specifically to human IGF-1R. In certain embodiments, an IGF-1R binding protein comprises a heavy chain and a light chain that associate with each other to form a binding moiety, e.g., an antibody, or an antigen binding domain thereof. The description provided herein applies to anti-IGF-1R antibodies, but also to anti-IGF-1R binding moieties that are comprised in PBAs. Conversely, the description of anti-IGF-1R binding moieties applies to anti-IGF-1R antibodies or to antigen binding sites thereof.

In certain embodiments, an anti-IGF-1R binding protein comprises 1, 2, 3, 4, 5, or 6 CDRs selected from the group consisting of a VHCDR1 aa sequence that is encompassed in the consensus sequence of SEQ ID NO:302, a VHCDR2 aa sequence that is encompassed in the consensus sequence of SEQ ID NO:303, a VHCDR3 aa sequence that is encompassed in the consensus sequence of SEQ ID NO:304, the VLCDR1 aa sequence of SEQ ID NO:305, a VLCDR2 aa sequence that is encompassed in the consensus sequence of SEQ ID NO:306, and a VLCDR3 aa sequence that is encompassed in the consensus sequence of SEQ ID NO:307 (or 308). For example, an anti-IGF-1R binding protein may comprise 1, 2, 3, 4, 5, or 6 CDRs selected from the group consisting of a VHCDR1, VHCDR2 and VHCDR3 aa sequences in one of the aa sequences of FIG. 1, e.g., any one of SEQ ID NOs:8-31, and a VLCDR1, VLCDR2 and VLCDR3 aa sequence in one of the aa sequences of FIG. 2, e.g., one of SEQ ID NOs:32-133. In a particular embodiment, an anti- IGF-1R binding protein comprises a VH domain comprising 1, 2, or 3, 4, 5, or 6 CDRs selected from the group consisting of a VHCDR1, VHCDR2 or VHCDR3 aa sequence of SEQ ID NO:11 and a VLCDR1, VLCDR2 and VLCDR3 aa sequence of SEQ ID NO:35 (CDRs of 16F). In certain embodiments, an anti-IGF-1R binding protein comprises a VH domain comprising 1, 2, 3, 4, 5, or 6 CDRs selected from the group consisting of a VHCDR1, VHCDR2 and VHCDR3 aa sequences of a sequence in FIG. 1, e.g., SEQ ID NOs:8-10 and 12-31, and a VLCDR1, VLCDR2 and VLCDR3 aa sequence that is of a sequence in FIG. 2, e.g., SEQ ID NOs: 32-34 and 36-133.

In certain embodiments, an anti-IGF-1R binding protein comprises a VH domain comprising an aa sequence that is encompassed by the consensus sequence of SEQ ID NO:1 and/or a VL domain comprising an aa sequence that is encompassed by the consensus sequence of SEQ ID NO:2. Exemplary VH aa sequences are those of FIG. 1, e.g., SEQ ID NOs:8-31. Exemplary VL aa sequences are those of FIG. 2, e.g., SEQ ID NO:32-133. In one embodiment, an anti-IGF-1R binding protein comprises a VH aa sequence comprising SEQ ID NO:11 and/or a VL aa sequence comprising SEQ ID NO:35 (variable domains of 16F).

In certain embodiments, an anti-IGF-1R binding protein comprises a VH domain comprising an aa sequence that is encompassed by the consensus sequence of SEQ ID NO:1 and/or a VL domain comprising an aa sequence that is encompassed by the consensus sequence of SEQ ID NO:3. Exemplary VH aa sequences are those set forth as SEQ ID NOs:8-10 and 12-31. Exemplary VL aa sequences are those set forth as SEQ ID NOs:32-34 and 36-133.

Also provided herein are anti-IGF-1R antibodies that bind specifically to IGF-1R, wherein the VH domain comprises an aa sequence that is at least 70%, 75%, 80%, 85%, 90%, 95%, 97%, 98% or 99% identical to the aa sequence of a VH aa sequence of FIG. 1, e.g., SEQ ID NOs:8-31, and/or wherein the VL domain comprises an aa sequence that is at least 70%, 75%, 80%, 85%, 90%, 95%, 97%, 98% or 99% identical to the aa sequence of a VL aa sequence of FIG. 2, e.g., SEQ ID NOs:32-133. In certain embodiments, the VH sequence of SEQ ID NO:11 and/or VL sequence of SEQ ID NO:35 is excluded.

Also provided herein are anti-IGF-1R antibodies that bind specifically to IGF-1R, wherein the VH domain comprises an aa sequence that differs in 1, 2, 3, 4, 5, 6, 7, 8, 9, 10, or in 1-5, 6-10, 11-15, 16-20, 21-25, 26-30, 31-35, 36-40, 41-45, 46-50 or 50-100 aa substitutions, additions or deletions from, an aa sequence of FIG. 1, e.g., SEQ ID NOs:8-31, and the VL domain comprises an aa sequence that differs in 1, 2, 3, 4, 5, 6, 7, 8, 9, 10, or in 1-5, 6-10, 11-15, 16-20, 21-25, 26-30, 31-35, 36-40, 41-45, 46-50 or 50-100 aa aa substitutions, additions or deletions from, an aa sequence of FIG. 2, e.g., SEQ ID NOs:32-133. In certain embodiments, the VH sequence of SEQ ID NO:11 and/or VL sequence of SEQ ID NO:35 is excluded.

Anti-IGF-1R antibodies may have the structure of an antibody, e.g., a full length antibody, or an antigen binding fragment thereof. For example, an anti-IGF-1R binding protein may comprise a heavy chain and a light chain, wherein the heavy chain comprises a in N- to C-terminal order: a VH domain, a CH1 domain, a hinge, a CH2 domain, a CH3 domain, and optionally a CH4 domain, and wherein the light comprises in N- to C-terminal order: a VL domain and a CL domain. The constant domains are preferably human and may be from IgG1, IgG2, IgG3, IgG4 or a combination thereof. The constant domains may be naturally occurring sequences or mutated sequences, wherein one or more aa substitution, addition or deletion has been made to the naturally occurring sequence(s).

An anti-IGF-1R binding protein may comprise a heavy chain comprising an aa sequence selected from the group consisting of SF heavy chain (SEQ ID NO:358); P4 heavy chain (SEQ ID NO:359); M78 heavy chain (SEQ ID NO:360) and M57 heavy chain (SEQ ID NO:361) (FIG. 6A). An anti-IGF-1R binding protein may also comprise a light chain comprising an aa sequence selected from the group consisting of SF kappa light chain (SEQ ID NO:202); P4 kappa light chain (SEQ ID NO:204); M78 kappa light chain (SEQ ID NO:206); and M57 kappa light chain (SEQ ID NO:208) (FIG. 5A). An anti-IGF-1R binding protein may comprise a heavy chain comprising an aa sequence selected from the group consisting of SF heavy chain (SEQ ID NO:358); P4 heavy chain (SEQ ID NO:359); M78 heavy chain (SEQ ID NO:360) and M57 heavy chain (SEQ ID NO:361) and a light chain comprising an aa sequence selected from the group consisting of SF kappa light chain (SEQ ID NO:202); P4 kappa light chain (SEQ ID NO:204); M78 kappa light chain (SEQ ID NO:206); and M57 kappa light chain (SEQ ID NO:208). In specific embodiments, IGF-1R antibodies comprise a heavy chain and a light chain having aa sequences having the same name, e.g., an SF heavy chain and an SF light chain, a P4 heavy chain and a P4 light chain, a M78 heavy chain and a M78 light chain, and a M57 heavy chain and a M57 light chain. However, heavy and light chains may also be mixed and matched. For example, an M57 heavy chain can be paired with a M7 light chain, and a P4 heavy chain can be paired with an M57 light chain.

Provided in particular are anti-IGF-1R IgG antibodies SF (heavy chain SEQ ID NO:358, kappa light chain SEQ ID NO:202); P4 (heavy chain SEQ ID NO:359, kappa light chain SEQ ID NO:204) M78 (heavy chain SEQ ID NO:360, kappa light chain SEQ ID NO:206) and M57 (heavy chain SEQ ID NO:361, kappa light chain SEQ ID NO:208); all of the IgG1 isotype.

In certain embodiments, an anti-IGF-1R binding protein comprises a heavy chain comprising an aa sequence that is at least 70%, 75%, 80%, 85%, 90%, 95%, 97%, 98% or 99% identical to an aa sequence of SEQ ID NOs:358, 359, 360 and 361 and/or a light chain comprising an aa sequence that is at least 70%, 75%, 80%, 85%, 90%, 95%, 97%, 98% or 99% identical to an aa sequence of SEQ ID NOs:202, 204, 206 and 208.

In other embodiments, an IGF-1R binding protein comprises a heavy chain comprising an aa sequence that that differs in 1, 2, 3, 4, 5, 6, 7, 8, 9, 10, or in 1-5, 6-10, 11-15, 16-20, 21-25, 26-30, 31-35, 36-40, 41-45, 46-50 or 50-100 aa substitutions, additions or deletions from an aa sequence of SEQ ID NOs:358, 359, 360 and 361 and/or a light chain comprises an aa sequence that differs in 1, 2, 3, 4, 5, 6, 7, 8, 9, 10, or in 1-5, 6-10, 11-15, 16-20, 21-25, 26-30, 31-35, 36-40, 41-45, 46-50 or 50-100 aa substitutions, additions or deletions from an aa sequence selected from the group consisting of SEQ ID NOs:202, 204, 206 and 208.

Biological activities and characteristics of anti-ErbB3 antibodies may be determined with assays, e.g., those described herein for PBAs. Anti-ErbB3 proteins may ligand-inhibit phosphorylation of ErbB3, proliferation of tumor cells and/or inhibition of tumor growth in vivo.

The anti-IGF-1R binding moieties may comprise, or be linked to, 1, 2, 3, 4 or more other binding sites, which may be in the form of a Fab, an scFv or other form of binding site. For example, an anti-IGF-1R binding protein may comprise an anti-ErbB3 binding site, e.g., an anti-ErbB3 scFv.

Anti-ErbB3 Antibodies

Also provided herein are anti-ErbB3 antibodies, which bind specifically to human ErbB3. In certain embodiments, an ErbB3 binding protein comprises a heavy chain and a light chain that associate with each other and form a binding protein, e.g., an antibody, or an antigen binding domain thereof. The description provided below applies to anti-ErbB3 antibodies, but also to anti-ErbB3 binding sites that are comprised in PBAs. Conversely, the description of anti-ErbB3 binding sites applies to anti-ErbB3 antibodies or antigen binding sites thereof.

In certain embodiments, an anti-ErbB3 binding protein comprises 1, 2, 3, 4, 5, or 6 CDRs selected from the group consisting of the VHCDR1 aa sequence of SEQ ID NO:309, a VHCDR2 aa sequence that is encompassed in the consensus sequence of SEQ ID NO:310, a VHCDR3 aa sequence that is encompassed in the consensus sequence of SEQ ID NO:311, the VLCDR1 aa sequence that is of SEQ ID NO:312, the VLCDR2 aa sequence that is of SEQ ID NO:313, and a VLCDR3 aa sequence that is encompassed in the consensus sequence of SEQ ID NO:314 (or 315). For example, an anti-ErbB3 binding protein may comprise 1, 2, 3, 4, 5, or 6 CDRs selected from the group consisting of a VHCDR1, VHCDR2 and VHCDR3 aa sequence of a sequence in FIG. 3, e.g., in any one of SEQ ID NOs:134-165, and a VLCDR1, VLCDR2 and VLCDR3 aa sequence of a sequence in FIG. 4, e.g., in SEQ ID NOs:166-200. In a particular embodiment, an anti-ErbB3 binding protein comprises a VH domain comprising 1, 2, or 3, 4, 5, or 6 CDRs selected from the group consisting of a VHCDR1, VHCDR2 or VHCDR3 aa sequence of SEQ ID NO:143 and a VLCDR1, VLCDR2 and VLCDR3 aa sequence of SEQ ID NO:175 (CDRs of 16F). In certain embodiments, an anti-ErbB3 binding protein comprises a VH domain comprising 1, 2, 3, 4, 5, or 6 CDRs selected from the group consisting of a VHCDR1, VHCDR2 or VHCDR3 aa sequence of FIG. 3, e.g., any one of SEQ ID NOs:134-142 and 144-165, and a VLCDR1, VLCDR2 and VLCDR3 aa sequence that is of FIG. 4, e.g., any one of SEQ ID NOs:166-174 and 176-200.

In certain embodiments, an anti-ErbB3 binding protein comprises a VH domain comprising an aa sequence that is encompassed by the consensus sequence of SEQ ID NO:4 and/or a VL domain comprising an aa sequence that is encompassed by the consensus sequence of SEQ ID NO:6. Exemplary VH aa sequences are those of FIG. 3, e.g., SEQ ID NOs:134-165. Exemplary VL aa sequences are those of Table 4, e.g., SEQ ID NO:166-200. In one embodiment, an anti-ErbB3 binding protein comprises a VH aa sequence comprising SEQ ID NO:143 and/or a VL aa sequence comprising SEQ ID NO:175 (variable domains of 16F).

In certain embodiments, an anti-ErbB3 binding protein comprises a VH domain comprising an aa sequence that is encompassed by the consensus sequence of SEQ ID NO:5 and/or a VL domain comprising an aa sequence that is encompassed by the consensus sequence of SEQ ID NO:7. Exemplary VH aa sequences are those set forth as SEQ ID NOs: 134-142 and 145-165. Exemplary VL aa sequences are those set forth as SEQ ID NOs:166-174 and 176-200.

Also provided herein are anti-ErbB3 antibodies that bind specifically to ErbB3, wherein the VH domain comprises an aa sequence that is at least 70%, 75%, 80%, 85%, 90%, 95%, 97%, 98% or 99% identical to the aa sequence of a VH aa sequence of FIG. 3, e.g, SEQ ID NOs:134-165, and/or wherein the VL domain comprises an aa sequence that is at least 70%, 75%, 80%, 85%, 90%, 95%, 97%, 98% or 99% identical to the aa sequence of a VL aa sequence of FIG. 4, e.g., SEQ ID NOs:166-200. In certain embodiments, the VH sequence of SEQ ID NO:143 and/or VL sequence of SEQ ID NO:175 is excluded.

Also provided herein are anti-ErbB3 antibodies that bind specifically to ErbB3, wherein the VH domain comprises an aa sequence that differs in 1, 2, 3, 4, 5, 6, 7, 8, 9, 10, or less of from 1-5, 6-10, 11-15, 16-20, 21-25, 26-30, 31-35, 36-40, 41-45, 46-50 or 50-100 aa substitutions, additions or deletions from, the aa sequence of FIG. 3, e.g., SEQ ID NOs:134-165, and the VL domain comprises an aa sequence that differs in 1, 2, 3, 4, 5, 6, 7, 8, 9, 10, or less of from 1-5, 6-10, 11-15, 16-20, 21-25, 26-30, 31-35, 36-40, 41-45, 46-50 or 50-100 aa substitutions, additions or deletions from, the aa sequence of FIG. 4, e.g., SEQ ID NOs:166-200. In certain embodiments, the VH sequence of SEQ ID NO:143 and/or VL sequence of SEQ ID NO:175 is excluded.

Anti-ErbB3 antibodies may have the structure of an antibody, e.g., a holo-antibody (full length antibody) or an antigen binding fragment thereof. For example, an anti-ErbB3 binding protein may comprise a heavy chain and a light chain, wherein the heavy chain comprises a in N- to C-terminal order: a VH domain, a CH1 domain, a hinge, a CH2 domain, a CH3 domain, and optionally a CH4 domain, and wherein the light comprises in N- to C-terminal order: a VL domain and a CL domain. The constant domains are preferably human and may be from IgG1, IgG2, IgG3, IgG4 or a combination thereof. The constant domains may be naturally occurring sequences or mutated sequences, wherein one or more aa substitution, addition or deletion has been made to the naturally occurring sequence(s).

An anti-ErbB3 binding protein may comprise a heavy chain comprising an aa sequence selected from the group consisting of P1 heavy chain (SEQ ID NO:362); M27 heavy chain (SEQ ID NO:363); M7 heavy chain (SEQ ID NO:364) B72 heavy chain (SEQ ID NO:365) and B60 (SEQ ID NO:366) (FIG. 5B). An anti-ErbB3 binding protein may also comprise a light chain comprising an aa sequence selected from the group consisting of P1 lambda light chain (SEQ ID NO:258); M27 lambda light chain (SEQ ID NO:260); M7 lambda light chain (SEQ ID NO:262); B72 lambda light chain (SEQ ID NO:264) and B60 lambda light chain (SEQ ID NO:266) (FIG. 5B). An anti-ErbB3 binding protein may comprise a heavy chain comprising an aa sequence selected from the group consisting of P1 heavy chain (SEQ ID NO:362); M27 heavy chain (SEQ ID NO:363); M7 heavy chain (SEQ ID NO:364) B72 heavy chain (SEQ ID NO:365) and B60 (SEQ ID NO:366) and a light chain comprising an aa sequence selected from the group consisting of P1 lambda light chain (SEQ ID NO:258); M27 lambda light chain (SEQ ID NO:260); M7 lambda light chain (SEQ ID NO:262); B72 lambda light chain (SEQ ID NO:264) and B60 lambda light chain (SEQ ID NO:266). In specific embodiments, IGF-1R antibodies comprise a heavy chain and a light chain having aa sequences having the same name, e.g., an P1 heavy chain and an P1 light chain, a M27 heavy chain and a M27 light chain, a M7 heavy chain and M7 light chain, a B72 heavy chain and a B72 light chain, and a B60 heavy chain and a B60 light chain. However, heavy and light chains may also be mixed and matched. For example, an M57 heavy chain can be paired with a M7 light chain, and a P4 heavy chain can be paired with an M57 light chain.

Also provided are anti-ErbB3 antibodies P1 (heavy chain SEQ ID NO:362, lambda light chain SEQ ID NO:258); M27 (heavy chain SEQ ID NO:363, lambda light chain SEQ ID NO:260); M7 (heavy chain SEQ ID NO:364, lambda light chain SEQ ID NO:262); B72 (heavy chain SEQ ID NO:365, lambda light chain SEQ ID NO:264); and B60 (heavy chain SEQ ID NO:366, lambda light chain SEQ ID NO:266); all of the IgG1 isotype.

In certain embodiments, an anti-ErbB3 binding protein comprises a heavy chain comprising an aa sequence that is at least 70%, 75%, 80%, 85%, 90%, 95%, 97%, 98% or 99% identical to an aa sequence of SEQ ID NOs:362, 363, 364, 365 and 366 and/or a light chain comprising an aa sequence that is at least 70%, 75%, 80%, 85%, 90%, 95%, 97%, 98% or 99% identical to an aa sequence of SEQ ID NOs:258, 260, 262, 264 and 266.

In other embodiments, an ErbB3 binding protein comprises a heavy chain comprising an aa sequence that that differs in 1, 2, 3, 4, 5, 6, 7, 8, 9, 10, or in 1-5, 6-10, 11-15, 16-20, 21-25, 26-30, 31-35, 36-40, 41-45, 46-500r 50-100 aa substitutions, additions or deletions from an aa sequence of SEQ ID NOs:362, 363, 364, 365 and 366 and/or a light chain comprises an aa sequence that differs in 1, 2, 3, 4, 5, 6, 7, 8, 9, 10, or in 1-5, 6-10, 11-15, 16-20, 21-25, 26-30, 31-35, 36-40, 41-45, 46-50 or 50-100 aa substitutions, additions or deletions from an aa sequence selected from the group consisting of SEQ ID NOs:258, 260, 262, 264 and 266.

Biological activities and characteristics of anti-ErbB3 antibodies may be determined with assays, e.g., those described herein for PBAs. Anti-ErbB3 proteins may ligand-inhibit phosphorylation of ErbB3, proliferation of tumor cells and/or inhibition of tumor growth in vivo. The anti-ErbB3 binding moieties may comprise, or be linked to, 1, 2, 3, 4 or more other binding sites, which may be in the form of a Fab, an scFv or other form of binding site. For example, an anti-ErbB3 binding protein may comprise an anti-IGF-1R binding site, e.g., an anti-IGF-1R scFv.

scFv Antibodies

Also provided are scFvs, e.g., isolated monoclonal scFvs. Exemplary scFvs are anti-IGF-1R scFvs and anti-ErbB3 scFvs. Exemplary scFvs are polypeptides comprising a VH domain and a VL domain that are linked together by an scFv linker. The VH and VL chains of an scFv are joined together by an scFv linker that is interposed between the VH and VL chains. scFv linkers may consist of a contiguous aa sequence of 10-30 aa, such as 15 to 20 aa.

Exemplary scFv linkers are Gly-Ser linkers (SEQ ID NO:399), which may be $(Gly_4Ser)_n$ (SEQ ID NO:401), wherein n is 1, 2, 3, 4, 5, 6, 7, 8, 9 or 10. Preferred scFv linkers comprise $(Gly_4Ser)_3$ (SEQ ID NO:396) or $(Gly_4Ser)_4$ (SEQ ID NO:397). Other preferred scFv linkers comprise 1-5 aa in addition to $(Gly_4Ser)_3$ (SEQ ID NO:396) or $(Gly_4Ser)_4$ (SEQ ID NO:397), e.g., AST, and may comprise the following aa sequence: $AST(Gly_4Ser)_3$ (SEQ ID NO:400) or $AST(Gly_4Ser)_4$ (SEQ ID NO:402).

An anti-IGF-1R scFv antibody may comprise a VH domain comprising a set of three VHCDRs comprising VHCDR1, VHCDR2 and VHCDR3, and a VL domain comprising a set of three VLCDRs comprising VLCDR1, VLCDR2 and VLCDR3, said CDRs comprising the aa sequences of SEQ ID NOs:302, 303 or 304, 305, 306 or 307 (or 308), respectively, and wherein each CDR further comprises an amino terminus and a carboxy terminus, wherein the CDRs of each set of CDRs are arranged in the variable domain in a linear amino to carboxy order of CDR1, CDR2 and CDR3, and wherein X aa in SEQ ID NOs:302, 304, 305, 306, 307 (or 308) represent variable aa, which may be any aa located in the corresponding position in FIG. 1 (for VH) and FIG. 2 (for VL). Anti-IGF-1R scFvs may comprise a VHCDR1, VHCDR2 and VHCDR3 of a VH domain consisting of an aa sequence of the group of VH aa sequences in FIG. 1, e.g., consisting of SEQ ID NOs:8-31, and/or a VLCDR1, VLCDR2 and VLCDR3 of a VL domain consisting of an aa sequence of the group of VL aa sequences in FIG. 2, e.g., consisting of SEQ ID NOs:32-133. In certain embodiments, an anti-IGF-1R scFv does not comprise all six CDRs of 16F or does not comprise either the VH domain of 16F and/or the VL domain of 16F. For example, an scFv comprises VH and VL aa sequences that differ from those in 16F in at least one aa.

Anti-IGF-1R scFv antibodies may comprise a VH domain comprising the aa sequence of SEQ ID NO:1 and/or a VL domain comprising the aa sequence set forth SEQ ID NO:2 (or 3), wherein the X aas in SEQ ID NOs:1, 2 and 3 are variable aa which may be any aa at the corresponding position in FIG. 1 (for the VH domain) and FIG. 2 (for the VL domain). Anti-IGF-1R scFv antibodies may comprise a VH domain comprising an aa sequence of FIG. 1, e.g., selected from the group consisting of SEQ ID NOs:8-31, and/or a VL domain comprising an aa sequence of FIG. 2, e.g., selected from the group consisting of SEQ ID NOs:32-133.

Exemplary anti-IGF-1R scFvs comprise a VH domain consisting of, or at least comprising the VHCDR1, VHCDR2 and VHCDR3 aa sequences of, an aa sequence selected from the group of VH aa sequences consisting of SEQ ID Nos:8, 9, 10 and 11 (the location of these CDRs is shown in FIG. 1). Anti-IGF-1R scFvs may also comprise a VL domain consisting of, or at least comprising the VLCDR1, VLCDR2 and VLCDR3 aa sequences of, an aa sequence selected from the group of VL aa sequences consisting of SEQ ID Nos:32, 33, 34 and 35 (the location of these CDRs is shown in FIG. 2). In certain embodiments, anti-IGF-1R scFvs comprise a VH domain consisting of, or at least comprising the VHCDR1, VHCDR2 and VHCDR3 aa sequences of, an aa sequence selected from the group of VH aa sequences consisting of SEQ ID Nos:8, 9, 10 and 11 and a VL domain consisting of, or at least comprising the VLCDR1, VLCDR2 and VLCDR3 aa sequences of, an aa sequence selected from the group of VL aa sequences consisting of SEQ ID Nos:32, 33, 34 and 35. In particular embodiments, an anti-IGF-1R scFv comprises a VH domain comprising the VH domain consisting of, or at least comprising the VHCDR1, VHCDR2 and VHCDR3 aa sequences of, SEQ ID No:8 and a VL domain consisting of, or at least comprising the VLCDR1, VLCDR2 and VLCDR3 aa sequences of, an aa sequence consisting of SEQ ID No:32 (M57 module). In particular embodiments, an anti-IGF-1R scFv comprises a VH domain comprising the VH domain consisting of, or at least comprising the VHCDR1, VHCDR2 and VHCDR3 aa sequences of, SEQ ID No:9 and a VL domain consisting of, or at least comprising the VLCDR1, VLCDR2 and VLCDR3 aa sequences of, an aa sequence consisting of SEQ ID No:33 (module M78). In particular embodiments, an anti-IGF-1R scFv comprises a VH domain comprising the VH domain consisting of, or at least comprising the VHCDR1, VHCDR2 and VHCDR3 aa sequences of, SEQ ID No:10 and a VL domain consisting of, or at least comprising the VLCDR1, VLCDR2 and VLCDR3 aa sequences of, an aa sequence consisting of SEQ ID No:34 (module P4). In particular embodiments, an anti-IGF-1R scFv comprises a VH domain comprising the VH domain consisting of, or at least comprising the VHCDR1, VHCDR2 and VHCDR3 aa sequences of, SEQ ID No:8 and a VL domain consisting of, or at least comprising the VLCDR1, VLCDR2 and VLCDR3 aa sequences of, an aa sequence consisting of SEQ ID No:33 (module M57/M78). In particular embodiments, an anti-IGF-1R scFv comprises a VH domain comprising the VH domain consisting of, or at least comprising the VHCDR1, VHCDR2 and VHCDR3 aa sequences of, SEQ ID No:10 and a VL domain consisting of, or at least comprising the VLCDR1, VLCDR2 and VLCDR3 aa sequences of, an aa sequence consisting of SEQ ID No:32 (module P4/M57).

An anti-ErbB3 scFv antibody may comprise a VH domain comprising a set of three VHCDRs comprising VHCDR1, VHCDR2 and VHCDR3, and a VL domain comprising a set of three VLCDRs comprising VLCDR1, VLCDR2 and VLCDR3, said CDRs comprising the aa sequences of SEQ ID NOs:309, 310 or 311, 312, 313 or 314 (or 315), respectively, and wherein each CDR further comprises an amino terminus and a carboxy terminus, wherein the CDRs of each set of CDRs are arranged in the variable domain in a linear amino to carboxy order of CDR1, CDR2 and CDR3, and wherein X aa in 309, 310 or 311, 312, 313 or 314 (or 315) represent variable aa, which may be any aa located in the corresponding position in FIG. 1 (for VH) and FIG. 2 (for VL). Anti-ErbB3 scFvs may comprise a VHCDR1, VHCDR2 and VHCDR3 of a VH domain consisting of an aa sequence of the group of VH aa sequences in FIG. 3, e.g., consisting of SEQ ID NOs:134-165 and/or a VLCDR1, VLCDR2 and VLCDR3 of a VL domain consisting of an aa sequence of the group of VL aa sequences in FIG. 4, e.g., consisting of SEQ ID NOs:166-200. In certain embodiments, an anti-ErbB3 scFv does not comprise all six CDRs of 16F or does not comprise either the VH domain of 16F and/or the VL domain of 16F. For example an scFv comprises VH and VL aa sequences that differ from those in 16F in at least one aa.

Anti-ErbB3 scFv antibodies may comprise a VH domain comprising the aa sequence of SEQ ID NO:4 (or 5) and/or a VL domain comprising the aa sequence set forth SEQ ID NO:6 (or 7), wherein the X aas in SEQ ID NOs:4, 5, 6 and 7 are variable aa which may be any aa at the corresponding position in FIG. 3 (for the VH domain) and FIG. 4 (for the VL domain). Anti-ErbB3 scFv antibodies may comprise a VH domain comprising an aa sequence in FIG. 3, e.g., selected from the group consisting of SEQ ID NOs:134-165, and/or a VL domain comprising an aa sequence in FIG. 4, e.g., selected from the group consisting of SEQ ID NOs:166-200.

Exemplary anti-ErbB3 scFvs comprise a VH domain consisting of, or at least comprising the VHCDR1, VHCDR2 and VHCDR3 aa sequences of, an aa sequence selected from the group of VH aa sequences consisting of SEQ ID Nos:134-143 (the location of these CDRs is shown in FIG. 3). Anti-ErbB3 scFvs may also comprise a VL domain consisting of, or at least comprising the VLCDR1, VLCDR2 and VLCDR3 aa sequences of, an aa sequence selected from the group of VL aa sequences consisting of SEQ ID Nos:166-175 (the location of these CDRs is shown in FIG. 4). In certain embodiments, anti-ErbB3 scFvs comprise a VH domain consisting of, or at least comprising the VHCDR1, VHCDR2 and VHCDR3 aa sequences of, an aa sequence selected from the group of VH aa sequences consisting of SEQ ID Nos:134-143 and a VL domain consisting of, or at least comprising the VLCDR1, VLCDR2 and VLCDR3 aa sequences of, an aa sequence selected from the group of VL aa sequences consisting of SEQ ID Nos:166-175. In particular embodiments, an anti-ErbB3 scFv comprises a VH domain comprising the VH domain consisting of, or at least comprising the VHCDR1, VHCDR2 and VHCDR3 aa sequences of, SEQ ID No:134 and a VL domain consisting of, or at least comprising the VLCDR1, VLCDR2 and VLCDR3 aa sequences of, an aa sequence consisting of SEQ ID No:166 (module B60). In particular embodiments, an anti-ErbB3 scFv comprises a VH domain comprising the VH domain consisting of, or at least comprising the VHCDR1, VHCDR2 and VHCDR3 aa sequences of, SEQ ID No:135 and a VL domain consisting of, or at least comprising the VLCDR1, VLCDR2 and VLCDR3 aa sequences of, an aa sequence consisting of SEQ ID No:167 (B72). In particular embodiments, an anti-ErbB3 scFv comprises a VH domain comprising the VH domain consisting of, or at least comprising the VHCDR1, VHCDR2 and VHCDR3 aa sequences of, SEQ ID No:136 and a VL domain consisting of, or at least comprising the VLCDR1, VLCDR2 and VLCDR3 aa sequences of, an aa sequence consisting of SEQ ID No:168 (module M27). In particular embodiments, an anti-ErbB3 scFv comprises a VH domain comprising the VH domain consisting of, or at least comprising the VHCDR1, VHCDR2 and VHCDR3 aa sequences of, SEQ ID No:137 and a VL domain consisting of, or at least comprising the VLCDR1, VLCDR2 and VLCDR3 aa sequences of, an aa sequence consisting of SEQ ID No:169 (M7 module). In particular embodiments, an anti-ErbB3 scFv comprises a VH domain comprising the VH domain consisting of, or at least comprising the VHCDR1, VHCDR2 and VHCDR3 aa sequences of, SEQ ID No:138 and a VL domain consisting of, or at least comprising the VLCDR1, VLCDR2 and VLCDR3 aa sequences of, an aa sequence consisting of SEQ ID No:170 (P1 module). In particular embodiments, an anti-ErbB3 scFv comprises a VH domain comprising the VH domain consisting of, or at least comprising the VHCDR1, VHCDR2 and VHCDR3 aa sequences of, SEQ ID No:139 and a VL domain consisting of, or at least comprising the VLCDR1, VLCDR2 and VLCDR3 aa sequences of, an aa sequence consisting of SEQ ID No:171 (M27 module). In particular embodiments, an anti-ErbB3 scFv comprises a VH domain comprising the VH domain consisting of, or at least comprising the VHCDR1, VHCDR2 and VHCDR3 aa sequences of, SEQ ID No:140 and a VL domain consisting of, or at least comprising the VLCDR1, VLCDR2 and VLCDR3 aa sequences of, an aa sequence consisting of SEQ ID No:172 (B69 module). In particular embodiments, an anti-ErbB3 scFv comprises a VH domain comprising the VH domain consisting of, or at least comprising the VHCDR1, VHCDR2 and VHCDR3 aa sequences of, SEQ ID No:141 and a VL domain consisting of, or at least comprising the VLCDR1, VLCDR2 and VLCDR3 aa sequences of, an aa sequence consisting of SEQ ID No:173 (P6 module). In particular embodiments, an anti-ErbB3 scFv comprises a VH domain comprising the VH domain consisting of, or at least comprising the VHCDR1, VHCDR2 and VHCDR3 aa sequences of, SEQ ID No:142 and a VL domain consisting of, or at least comprising the VLCDR1, VLCDR2 and VLCDR3 aa sequences of, an aa sequence consisting of SEQ ID No:174 (M1.3 module). In particular embodiments, an anti-ErbB3 scFv comprises a VH domain comprising the VH domain consisting of, or at least comprising the VHCDR1, VHCDR2 and VHCDR3 aa sequences of, SEQ ID No:143 and a VL domain consisting of, or at least comprising the VLCDR1, VLCDR2 and VLCDR3 aa sequences of, an aa sequence consisting of SEQ ID No:175 (C8 module). In particular embodiments, an anti-ErbB3 scFv comprises a VH domain comprising the VH domain consisting of, or at least comprising the VHCDR1, VHCDR2 and VHCDR3 aa sequences of, SEQ ID No:136 and a VL domain consisting of, or at least comprising the VLCDR1, VLCDR2 and VLCDR3 aa sequences of, an aa sequence consisting of SEQ ID No:169 (M27/M7 module).

Exemplary scFvs are anti-IGF-1R scFv antibodies P4 (SEQ ID NO:367), M57 (SEQ ID NO:368), M78, (SEQ ID NO:369), and M76 (SEQ ID NO:382); as well as anti-ErbB3 scFv antibodies C8 (SEQ ID NO:370), P1 (SEQ ID NO:371), M1.3 (SEQ ID NO:372), M27 (SEQ ID NO:373), P6 (SEQ ID NO:374), B69 (SEQ ID NO:375) and P6L (SEQ ID NO:383).

scFvs may also comprise a CDR, a variable domain or their full length aa that differs from a CDR, variable domain, or full length scFv, respectively, set forth herein in one or more aa additions, deletions or substitutions, while retaining their binding properties. For example, a CDR may differ in 1 or 2 aa from a CDR sequence provided herein; a variable domain may differ in 1, 2, 3, 4, 5, 6, 7, 8, 9 or 10 aa from a variable domain sequence provided herein; and an scFv may differ in 1, 2, 3, 4, 5, 6, 7, 8, 9, 10, 20, 30, 40 or 50 aa from an scFv, respectively, provided herein. An scFv may also comprise a CDR, a variable domain or its full length aa sequence that is at least 70%, 80%, 85%, 90%, 95%, 97%, 98%, or 99% identical to a sequence of a CDR, variable domain or full length scFv sequence provided herein. In one embodiment, an scFv comprises an aa sequence that is at least 70%, 80%, 85%, 90%, 95%, 97%, 98%, or 99% identical to an aa sequence selected from the group of scFv sequences consisting of SEQ ID NO:367, 368, 369, 370, 372, 373, 374, and 375.

In certain embodiments, scFvs comprise 1, 2, 3, 4, 5, 6, 7, 8, 9 or 10 aas at the amino terminus or carboxy terminus of the VL domain. For example, if the carboxy terminus of an scFv of interest would be an aa that can be clipped off by an enzyme, such as a carboxypeptidase (e.g., a lysine or an arginine), one or more aa may be added to prevent the aa from being clipped. For example, the aa "RT" from the CL domain may be added to the carboxy terminus "VEIK" in anti-IGF-1R scFvs, as shown, e.g., in SEQ ID NOs:367-369.

Nucleic Acids, Expression Vectors and Host Cells

Provided herein are nucleic acids, e.g., DNA or RNA, encoding the polypeptides described herein. Exemplary nucleotide sequences provided herein are those encoding the aa sequences of FIGS. 1-7, such as the nucleotide sequences of the Appendix, or portions thereof, such as portions that encode 1, 2, 3, 4 or 5 domains. Nucleotide sequences that are at least 50%, 60%, 70%, 75%, 80%, 85%, 90%, 95%, 97%, 98%, or 99% identical to a nucleotide sequence encoding an aa sequence set forth herein, e.g., the nucleotide sequences set forth herein are also encompassed. Such nucleotide sequences may encode a protein set forth herein or may encode a protein that is at least 70%, 75%, 80%, 85%, 90%, 95%, 97%, 98% or 99% identical or similar to a protein set forth herein or a portion thereof (e.g., a domain), such as an aa sequence of any one of FIGS. 1-7.

A nucleotide sequence encoding the heavy chain of 16F with a leader sequence (aa sequence SEQ ID NO:300) is set forth as SEQ ID NO:299. A nucleotide sequence encoding the light chain of 16F with a leader sequence (aa sequence SEQ ID NO:298) is set forth as SEQ ID NO:297.

In certain embodiments, a nucleic acid encodes the heavy and/or the light chain of an antibody that comprises a leader sequence (or signal peptide). An exemplary leader sequence is that shown in FIG. 7 for 16F. Accordingly, also provided herein are antibodies, e.g., those shown in FIGS. 5 and 6, linked to a leader sequence, such as that shown in FIG. 7, and nucleic acids encoding such.

In certain embodiments, a nucleic acid is linked to a sequence that enhances or promotes the expression of the nucleotide sequence in a cell to produce a protein. Such nucleic acids may be encompassed within a vector, e.g., an expression vector. For expressing a protein that is a transmembrane protein, it is also preferable to include a signal sequence, e.g., the one of FIG. 7A, which signal sequence is frequently deleted to form a mature protein.

Also encompassed herein are cells, e.g., a host cell comprising a nucleic acid or a vector provided herein.

The antibodies described herein may be produced by recombinant means. Methods for recombinant production are widely known in the state of the art and comprise protein expression in prokaryotic and eukaryotic cells with subsequent isolation of the antibody and usually purification to a pharmaceutically acceptable purity. For the expression of the antibodies in a host cell, nucleic acids encoding the respective polypeptides, e.g., light and heavy chains, are inserted into expression vectors by standard methods. Expression is performed in appropriate prokaryotic or eukaryotic host cells like CHO cells, NSO cells, SP2/0 cells, HEK293 cells, COS cells, PER.C6 cells, yeast, or *E. coli* cells, and the binding protein is recovered from the cells (supernatant or cells after lysis). General methods for recombinant production of antibodies are well-known in the art.

The antibodies may be suitably separated from the culture medium by conventional immunoglobulin purification procedures such as, for example, protein A-Sepharose, hydroxylapatite chromatography, gel electrophoresis, dialysis, or affinity chromatography. DNA and RNA encoding the antibodies are readily isolated and sequenced using conventional procedures. The hybridoma cells can serve as a source of such DNA and RNA. Once isolated, the DNA may be inserted into expression vectors, which are then transfected into host cells such as HEK 293 cells, CHO cells, or myeloma cells that do not otherwise produce immunoglobulin protein, to obtain the synthesis of recombinant antibodies in the host cells.

Aa sequence variants (e.g., mutants) of the antibodies may be prepared by introducing appropriate nucleotide changes into the antibody DNA, or by nucleotide synthesis.

"Host cell" denotes any kind of cellular system which can be engineered to generate the antibodies described herein. In one embodiment, HEK293 cells and CHO cells are used as host cells, in another CHO or NSO cells are used.

The control sequences that are suitable for prokaryotes, for example, include a promoter, optionally an operator sequence, and a ribosome binding site. Eukaryotic cells are known to utilize promoters, enhancers and polyadenylation signals.

A nucleic acid is "operably linked" when it is placed in a functional relationship with another nucleic acid sequence. For example, DNA for a pre-sequence or secretory leader is operably linked to DNA for a polypeptide if it is expressed as a pre-protein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites. If such sites do not exist, the synthetic oligonucleotide adaptors or linkers are used in accordance with conventional practice.

Purification of antibodies may be performed in order to eliminate cellular components or other contaminants, e.g., other cellular nucleic acids or proteins, by standard techniques, including alkaline/SDS treatment, CsCl banding, column chromatography, agarose gel electrophoresis, and others well known in the art. Different methods are well established and widespread used for protein purification, such as affinity chromatography with microbial proteins (e.g., protein A or protein G affinity chromatography), ion exchange chromatography (e.g., cation exchange (carboxymethyl resins), anion exchange (amino ethyl resins) and mixed-mode exchange), thiophilic adsorption (e.g., with beta-mercaptoethanol and other SH ligands), hydrophobic interaction or aromatic adsorption chromatography (e.g., with phenyl-sepharose, aza-arenophilic resins, or m-aminophenylboronic acid), metal chelate affinity chromatography (e.g., with Ni(II)- and Cu(II)-affinity material), size exclusion chromatography, and electrophoretical methods (such as gel electrophoresis, capillary electrophoresis).

Methods of Using Antibodies Provided Herein

Provided herein are methods of using the antibodies described herein, e.g., an anti-IGF-1R+anti-ErbB3 PBA, an anti-IGF-1R antibody and an anti-ErbB3 antibody, for therapeutic applications. The antibodies disclosed herein can be used for treating a disease or disorder associated with ErbB3 and/or IGF-1R dependent signaling, including a variety of cancers.

In one embodiment, a method is provided for inhibiting proliferation of a tumor cell expressing IGF-1R and ErbB3 comprising contacting the tumor cell with an anti-IGF-1R+anti-ErbB3 bispecific (optionally polyvalent) antibody, such that proliferation of the tumor cell is inhibited, slowed down, or stopped or such that the tumor cell dies.

Provided herein are methods for treating a disease or disorder associated with ErbB3 and/or IGF-1R dependent signaling by administering to a patient an antibody disclosed herein in an amount effective to treat the disease or disorder. Suitable diseases or disorders include, for example, a variety of cancers including, but not limited to, breast cancer and those set forth below. In one embodiment, a method for treating a subject having a proliferative disease, such as cancer, comprises administering to a subject in need thereof a therapeutically effective amount of one or more antibodies described herein, such as an anti-IGF-1R+anti-ErbB3 bispecific antibody.

Also provided is a method for (or a bispecific antibody e.g., in a medicament for) treating a tumor expressing IGF-1R and ErbB3 in a patient, the method comprising administering an effective amount of an antibody as described herein (e.g., effective to slow or stop tumor growth, or to shrink a tumor or to slow or stop tumor invasiveness or tumor metastasis). Any tumor expressing IGF-1R and ErbB3 may be treated, including tumors of the following cancers: lung cancer, sarcoma, colorectal cancer, pancreatic cancer, prostate cancer, renal cell carcinoma, head and neck squamous cell carcinoma (HNSCC), melanoma and breast cancer. Particular examples of such tumors include: non-small cell lung cancer, Ewing's sarcoma, tamoxifen-resistant estrogen-receptor-positive breast cancer, trastuzumab-resistant or lapatinib-resistant HER2-positive metastatic breast cancer, gefitinib-resistant or erlotinib-resistant lung cancer, cetuximab-resistant or panitumumab-resistant colorectal cancer, cetuximab-resistant head and neck squamous cell carcinoma (HNSCC), and erlotinib-resistant pancreatic cancer.

Also provided are kits comprising one or more antibodies disclosed herein. The kits may include a label indicating the intended use of the contents of the kit and optionally including instructions for use of the kit in treating a disease or disorder associated with ErbB3 and/or IGF-1R dependent signaling, e.g., treating a tumor. The term label includes any writing, marketing materials or recorded material supplied on or with the kit, or which otherwise accompanies the kit.

A method of treating a tumor herein provided can further comprise administering a second anti-cancer agent in combination with the antibody. Thus novel pharmaceutical compositions are contemplated comprising an antibody disclosed herein, together with a second anti-cancer agent, typically a biologic agent, together with at least one pharmaceutically acceptable carrier or excipient.

Pharmaceutical Compositions

In another aspect, a composition, e.g., a pharmaceutical composition, is provided for treatment of a tumor in a patient, as well as methods of use of each such composition to treat a tumor in a patient. The compositions provided herein contain one or more of the antibodies disclosed herein, formulated together with a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the antibody may be coated in a material to protect it from the action of acids and other natural conditions that may inactivate proteins.

Pharmaceutical compositions may be administered alone or in combination therapy, i.e., combined with other agents. For example, the combination therapy can include an antibody of the present disclosure with at least one additional therapeutic agent, such as an anti-cancer agent. Pharmaceutical compositions can also be administered in conjunction with another anti-cancer treatment modality, such as radiation therapy and/or surgery.

A composition of the present disclosure can be administered by a variety of methods known in the art. As will be appreciated by the skilled artisan, the route and/or mode of administration will vary depending upon the desired results.

To administer a composition provided herein by certain routes of administration, it may be necessary or desirable to coat the antibody with, or co-administer the antibody with, a material to prevent its inactivation. For example, the antibody may be administered to a patient in an appropriate carrier, for example, in liposomes, or a diluent. Pharmaceutically acceptable diluents include saline and aqueous buffer solutions. Liposomes include water-in-oil-in-water CGF emulsions as well as conventional liposomes.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any excipient, diluent or agent is incompatible with the active compound, use thereof in the pharmaceutical compositions provided herein is contemplated. Supplementary active compounds (e.g., additional anti-cancer agents) can also be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. Saline solutions and aqueous dextrose and glycerol solutions can be employed as liquid carriers, particularly for injectable solutions. The composition, if desired, can also contain minor amounts of wetting or solubility enhancing agents, stabilizers, preservatives, or pH buffering agents. In many cases, it will be useful to include isotonic agents, for example, sodium chloride, sugars, polyalcohols such as mannitol, sorbitol, glycerol, propylene glycol, and liquid polyethylene glycol in the composition. Prolonged absorption of the injectable compositions can be brought about by including in the composition an agent that delays absorption, for example, monostearate salts and gelatin.

EXAMPLES

The following examples should not be construed as limiting the scope of this disclosure.

Materials and Methods

Throughout the examples, the following materials and methods are used unless otherwise stated. In general, the practice of the techniques of the present disclosure employs, unless otherwise indicated, conventional techniques of chemistry, molecular biology, recombinant DNA technology, immunology (especially, e.g., antibody technology), pharmacology, pharmacy, and standard techniques in polypeptide preparation.

Ligands

As used in these Examples and in the Figs., "HRG" refers to the isoform of heregulin known as heregulin 1 beta 1 (sometimes referred to as HRG1-B, HRG-β1, neuregulin 1, NRG1, neuregulin 1 beta 1, NRG1-b1, or HRG ECD) e.g., R&D Systems, 377-HB-050/CF. As used in these Examples and in the Figs., IGF-1 refers to insulin-like growth factor 1, e.g., R&D Systems, 291-GI-050/CF.

Cell Lines

All the human cell lines for use in the experiments described below may be obtained, as indicated, from American Type Culture Collection (ATCC, Manassas, Va.) or the US National Cancer Institute (NCI) e.g., from the Division of Cancer Treatment and Diagnostics (DCTD).

MCF7—ATCC® cat. No. HTB-22™
ADRr—NCI (redesignated NCI/ADR-RES)
BxPC-3—ATCC® cat. No. CRL-1687™
DU145—ATCC® cat. No. HTB-81™
Caki-1—ATCC® cat. No. HTB-46™
SK-ES-1—ATCC® cat. No. HTB-86™

The mouse anti-human-IGF-1R monoclonal antibody mAb391 (IgG1, R & D Systems MAB391) is used as an anti-IGF-1R IgG antibody control.

Example 1

Figure 9A:
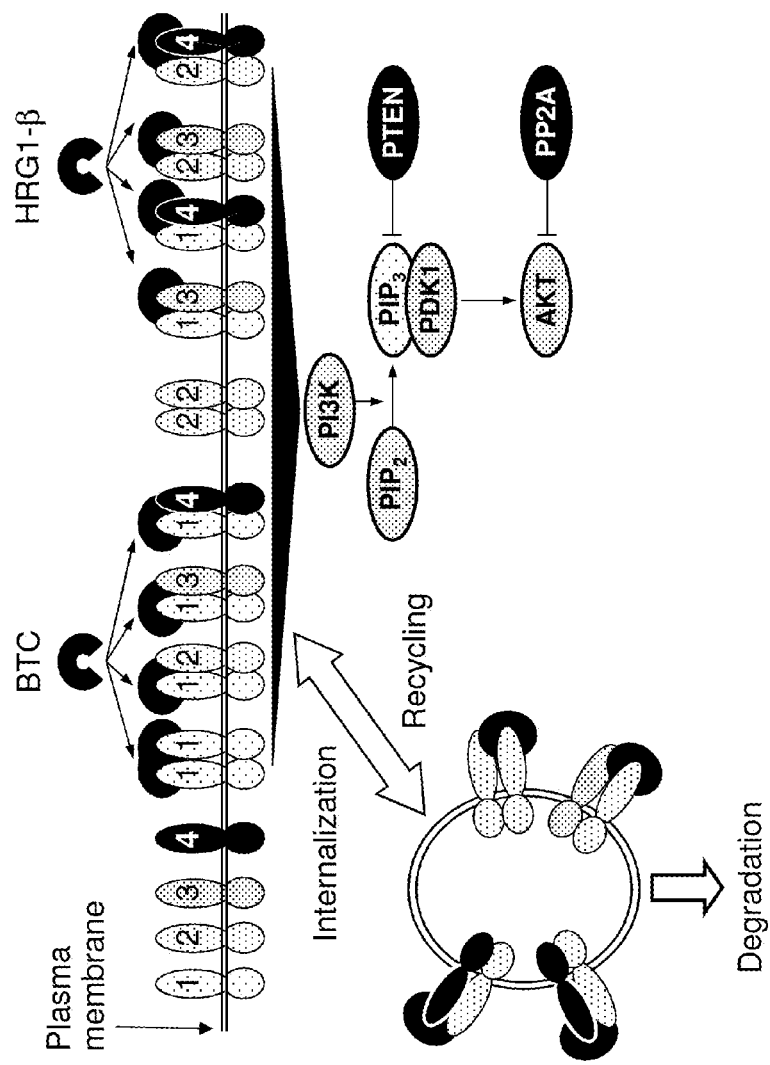

Rational Engineering of Antibody Therapeutics Targeting Multiple Signaling Pathways The ErbB pathway has long been the focus of cancer research due to the high expression of the ErbB receptors in specific cancer types: HER2/ErbB2 is gene amplified in some breast cancers, and EGFR/ErbB1 is highly expressed in colon cancers and NSCLC. For two members of the pathway EGFR/ErbB1 and HER2/ErbB2, there are approved monoclonal antibody agents (e.g., cetuximab and trastuzumab) and small molecule tyrosine kinase inhibitors (e.g., erlotinib, lapatinib). These therapeutics perturb the ability of extracellular stimuli to activate downstream intracellular signaling networks; however, it is difficult to determine what represents an optimal therapeutic strategy given that the ErbB signaling network is quite complex (FIG. 9A). In addition to EGFR/ErbB1 and HER2/ErbB2 (devoid of ligand binding activity), there are two other members of ErbB pathway—ErbB3 (kinase-dead) and ErbB4. All four receptors can dimerize with each other to various degrees following ligand activation, contributing to an essential step required for intracellular signal transmission. Following dimerization, the receptors can be internalized and recycled at rates that depend on the type of dimer, as well as on the activation status of downstream signaling pathways, such as the PI3K pathway.

Figure 9B:
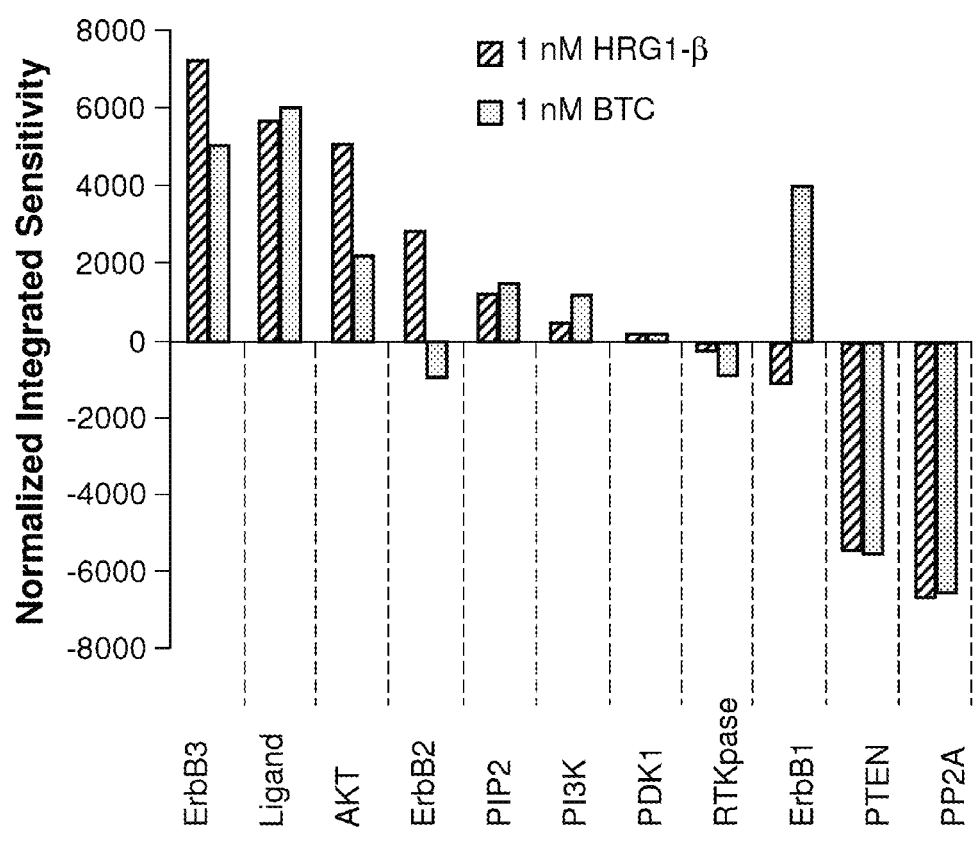

The complexity of the ErbB network, combined with the ability to measure the abundance and activation state of key components, lends the network to computational modeling. By using computational modeling a number of biological phenomena can be well described, such as the dimerization-dependence of receptor trafficking, control of signal amplification through feedback loops and ligand-dependence of signal propagation. For example, to determine an optimal strategy to inhibit the ErbB pathway, a network model was built to describe the activation of the PI3K/AKT pathway in response to the ligands betacellulin and heregulin, which selectively activate EGFR/ErbB1 or ErbB3 heterodimers, respectively. The mechanistic model represented the processes of: ligand binding; receptor dimerization; receptor trafficking and signal propagation, with a series of reactions defined by mass-action kinetics. In order to make reliable predictions, mechanistic models have to be first trained using temporal and dose-dependent experiments that capture key dynamic events, specifically the activation of the ErbB receptors and PI3K/AKT pathway. Network components with the greatest influence were identified by sensitivity analysis, where each component of the network is subtly perturbed and the relative contribution to the downstream output is assessed (FIG. 9B).

Using these methods a computational model of the ErbB network was generated, which identified the kinase-dead ErbB3 as the strongest activator of the PI3K/AKT pathway. In fact, despite its low expression level, in the presence of either heregulin or betacellulin ErbB3 provided the strongest contribution toward activation of the PI3K/AKT pathway in the model. Notably, this in silico observation applied even to cell lines expressing relatively low levels of ErbB3 and 10-fold higher levels EGFR/ErbB1 or HER2/ErbB2.

Figure 9C:
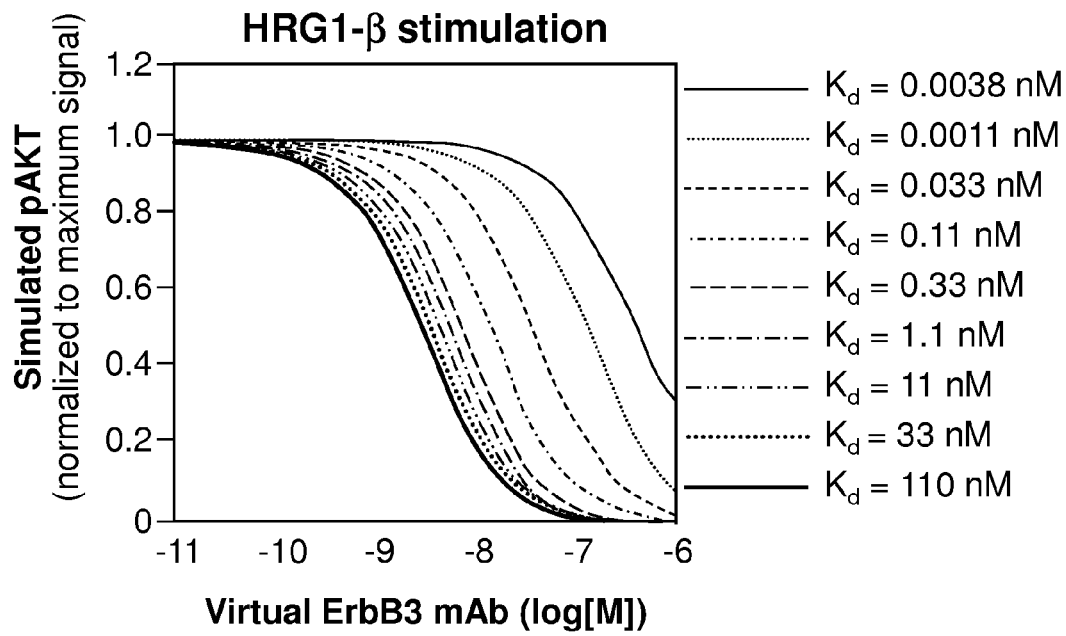
Figure 9D:
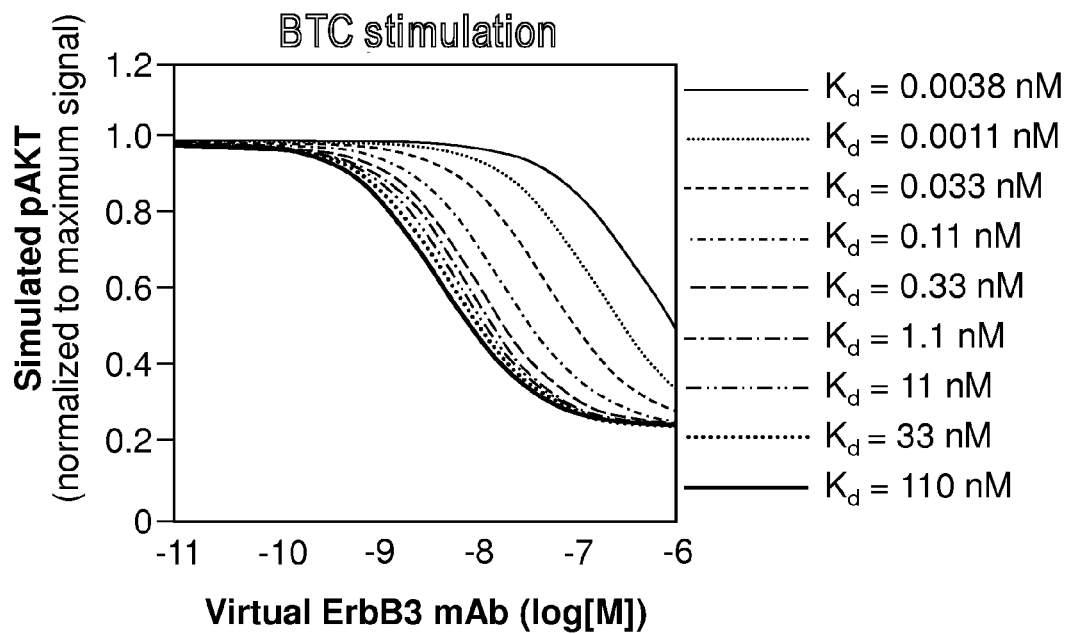

In addition to identifying optimal targets, mechanistic modeling can be also used to determine optimal therapeutic design characteristics. In the case of targeting the kinase-dead ErbB3, optimization simulations of a therapeutic monoclonal antibody explored several design characteristics, such as binding to ErbB3, preventing heregulin binding, and blockade of dimerization, with a special focus on blocking ligand-induced EGFR/ErbB3 dimerization. Simulation was used to determine the affinity required to achieve maximal inhibition of AKT phosphorylation through simulation of inhibitors within a range of dissociation rate constants. From this simulation, a 1 nanomolar affinity was predicted to be sufficient for maximal inhibitor potency, with higher affinity inhibitors displaying only limited improvement (FIG. 9C and FIG. 9D).

The added complexity of a bispecific agent interacting with a biological system creates an even greater opportunity to utilize mechanistic modeling to guide engineering efforts. All bispecific proteins bind their targets in a manner dependent on the affinity for each target, avidity-enhanced crosslinking ability and the relative abundance of each target. Designing a bispecific optimized for potent inhibition also requires knowledge of the affinity of competing ligands and dimerization partners, if such exist, as well as the relative strength of each target in activating common downstream signaling cascades and subsequent cell growth and survival mechanisms. The desirable apparent Kd can be achieved through multiple rounds of affinity and avidity improvements, and the simulation model can guide engineering efforts towards the most suitable molecular format and streamlined optimization route. Simulation can be used to explore the performance of a bispecific protein concept for permutations of target affinity, avidity and target expression levels.

A Bispecific Antibody Designed to Inhibit Two Cell Surface Growth Factor Receptors (IGF-1R, ERBB3) with a Single Binding Moiety Directed Towards Each Target All bispecific proteins bind their targets in a manner dependent on the affinity for each target, avidity-enhanced crosslinking ability and the relative abundance of each target; the added complexity of a bispecific interacting with a biological system creates an even greater opportunity to utilize mechanistic modeling to guide engineering efforts. Designing a bispecific optimized for potent inhibition also requires knowledge of the affinity of competing ligands and dimerization partners, if such exist, as well as the relative strength of each target in activating common downstream signaling cascades and subsequent cell growth and survival mechanisms. The desirable apparent Kd can be achieved through multiple rounds of affinity and avidity improvements, and the simulation model can guide engineering efforts towards the most suitable molecular format and streamlined optimization route. Simulation can be used to explore the performance of a bispecific protein concept for permutations of target affinity, avidity and target expression levels.

Figure 10A:
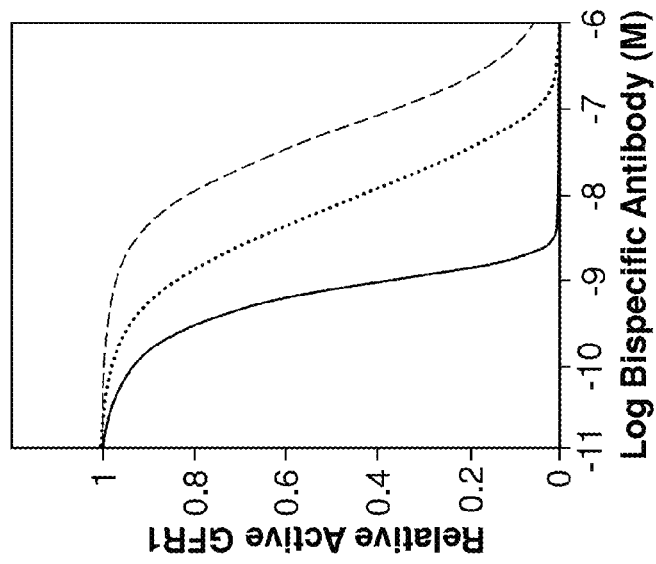
Figure 10B:
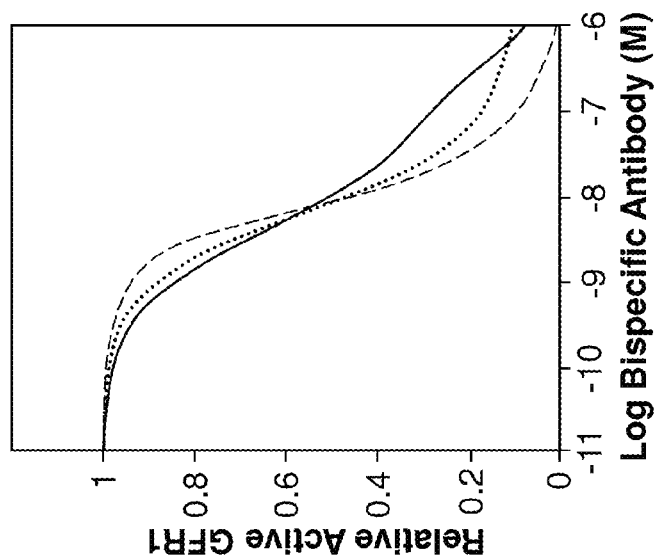
Figure 10C:
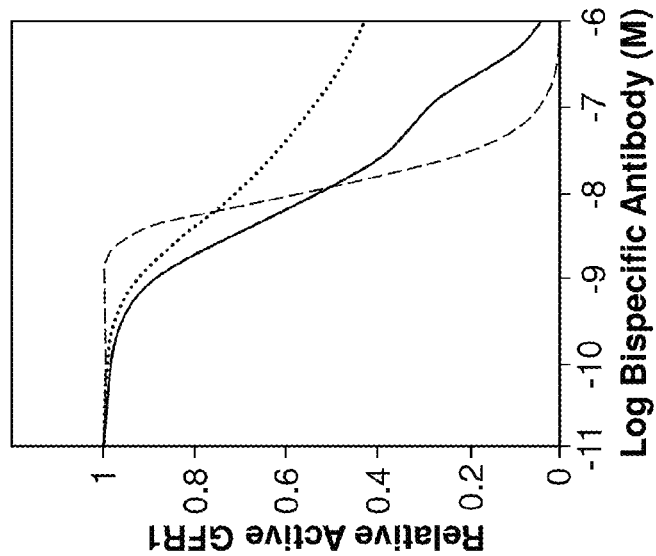

Simulating the dose-response behavior of a bispecific antibody designed to inhibit two cell surface growth factor receptors (IGF-1R and ErbB3) with a single binding moiety directed towards each target in this system reveals that IGF-1R is more potently inhibited when ErbB3 is more highly expressed and less potently inhibited when ErbB3 more scarcely expressed (FIG. 10A). Therefore, the ability of the bispecific antibody to inhibit IGF-1R depends on its avid binding. This phenomenon is specific to both the relative expression of the targets and the relative affinities of the bispecific antibody towards the targets: inhibition of ErbB3 is less affected by the expression of IGF-1R as the bispecific antibody is simulated to bind to ErbB3 with a higher affinity than IGF-1R (FIG. 10B). For a bispecific inhibitor this receptor level-dependent behavior can seriously limit overall efficacy, as depicted in the simulated effect on a downstream intracellular readout common to both pathways, AKT: poor inhibition of pAKT is predicted when ErbB3 is under-expressed as IGF-1R is not sufficiently inhibited (FIG. 10C). Simulation of this model system reveals that the performance of bispecific inhibitors towards each target can be highly dependent on the relative expression of both targets; information that can be useful for therapeutic design.

The impact of receptor level dependence on the potency of a bispecific can be extensively explored through simulation of many hypothetical cancer cells where the expression level of each target is varied over a clinically-relevant range and the IC50 of each target and downstream readout is calculated and plotted on a response surface. The shape of the IC50 response surface depends on the underlying pathway interactions. ErbB3 is the stronger activator of downstream signaling, and defines the area where the bispecific inhibitor would be most efficacious. Simulation of a bispecific with single binding moieties to each target reveals that the most potent inhibition of the downstream target is centered on regions of equal target expression. In fact, when either target is overexpressed by as little as 5-fold the IC50 value can increase as much as 100-fold, with a substantial loss in potency.

Mapping actual target levels in tumor cell lines or clinical samples onto the IC50 response surface can be used to guide therapeutic improvement efforts by revealing if the region of most potent inhibition overlaps with the relevant patient population. Strategies to shift the region of predicted optimal potency to treat a different or broader patient population can be explored first through simulation. IgG-like bispecific antibodies have two binding moieties towards each target and therefore exhibit same-target avidity in addition to cross-target avidity, improving the effective binding affinity for each target. Simulation of the IgG-like bispecific antibody that has monovalent binding affinities equal to the bivalent bispecific protein shows that this format is less dependent on cross-target avidity for performance: The region of optimal potency is broader than the monovalent bispecific. Therefore, if the goal is to treat a broad patient population the model prediction would be to use an IgG-like bispecific design.

The benefit of affinity maturation of antibody function in improving the region of optimal potency can also be examined through simulation. Simulating downstream target inhibition across the receptor space by a non-optimal tetravalent bispecific identifies areas of poor inhibition, particularly when IGF-1R is more highly expressed. Increasing the monovalent binding affinity of the bispecific towards IGF-1R by 10-fold through lowering the dissociation rate predicts the improvement affinity maturation would achieve. The downstream target is inhibited significantly more potently both where the IGF-1R is more highly expressed and where the ErbB3 is more highly expressed indicating that affinity maturation towards one target is enhancing the potency towards the second target through cross-target avidity.

These considerations were set as criteria for an optimization campaign of a proof-of-concept IgG-like bispecific therapeutic protein that showed potent inhibition of growth-factor induced signaling and tumor inhibition in xenograft models validating the design criteria. This protein comprised an IgG antibody framework directed at IGF-1R and two C-terminally fused scFv modules directed at ErbB3, but was not suitable for downstream development, as it contained unstabilized scFv modules that do not have sufficient intrinsic stability. This phenomenon is well understood and engineering of scFv modules for stability has been described using a variety of techniques, including linker optimization, disulfide engineering, targeted mutagenesis, co-variation analysis, loop grafting on stable framework, structure-guided design, focused design and phage display.

Figure 11A:
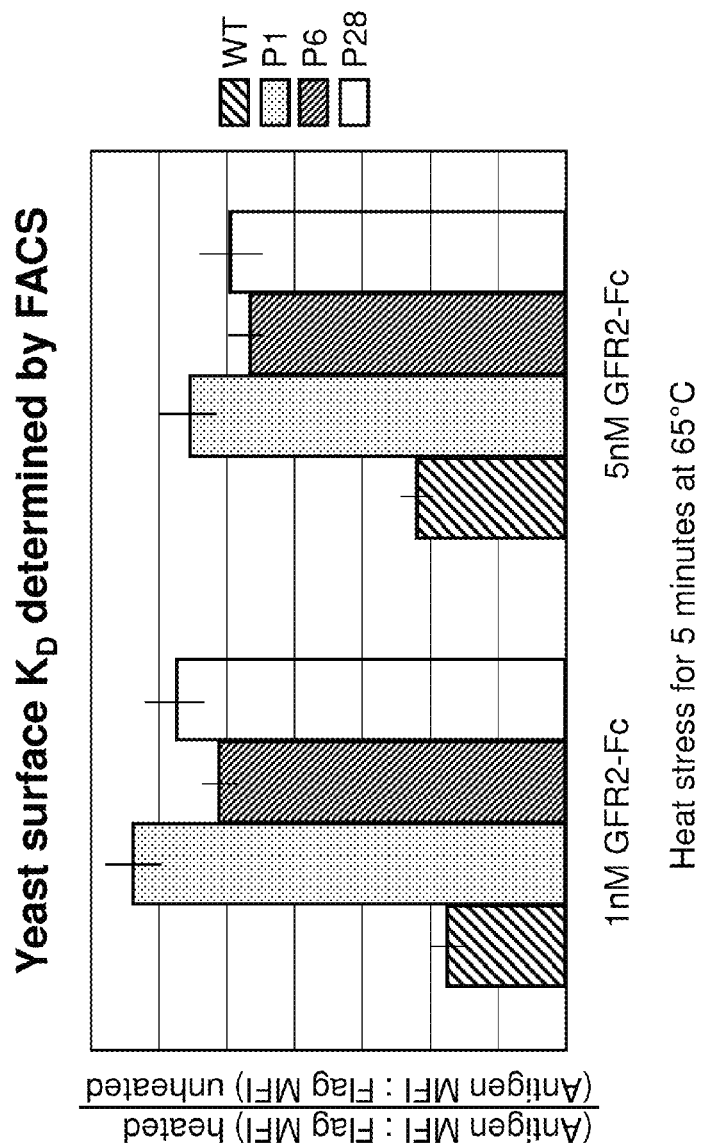

To combine optimization of the scFv modules affinity and stability within a single campaign a combination of structure-guided design, yeast surface display and micro scale biophysical characterization was used. Structure-guided scFv variants were designed where stability enhancing mutations were introduced, motifs conferring potential CMC liabilities were mutated, atypical framework aas were removed or replaced, and variation in low diversity portions of the CDRs was introduced. Since yeast cells have eukaryotic posttranslational modification and polypeptide export machinery, surface expression levels that were reported to predict thermal stability and soluble secretion efficiency were monitored. In addition a thermal challenge "cook-and-bind" protocol was developed. In this experiment the unstable scFv modules unfolded, while the stable high affinity proteins retained binding to the antigen and therefore were enriched (FIG. 11A). After isolation of individual clones, scFvs fused to the yeast surface were challenged and clones were selected based on the residual affinity measured by a flow cytometry (FIG. 11B). Thermostable scFv modules that showed over 10-fold improvement in Kd on the yeast surface were produced as soluble proteins and those showing improved antigen binding, inhibition of growth factor signaling, and acceptable stability were selected. These optimized scFv modules were C-terminally fused to the IGF-R1 antibody. The resulting IgG-like proteins were expressed in a transient expression system, purified using protein A chromatography, and profiled using biophysical, biochemical, and cell signaling assays. Among many useful biophysical techniques, differential scanning fluorescence and thermal inactivation assays were found to be most informative at the 1 to 5 microgram scale. Micro-scale triage composed of differential scanning fluorescence profiling and thermal inactivation assays allow the selection of bispecifics with improved serum and aggregation stabilities. Differential scanning fluorescence profiling and thermal inactivation assays give complementary information on the rate of unfolding and the rate of aggregation for the least stable protein domain. These data qualitatively predict the serum and aggregation stability of an IgG-like bispecific antibody (FIG. 12). The importance of having a robust sensitive micro scale assay is difficult to overestimate, as it directly translates into the ability to interrogate a larger number of diverse candidates within a single design campaign. The improved potency and stability of the engineered IgG-like bispecific protein was confirmed using a normal scale assay: binding to BxPC-3 cells that express both targets (FIG. 13). This demonstrates that an approach featuring parallel focused engineering of the modules of a multifunctional protein, followed by high-throughput production and characterization is generally applicable to improving potency and manufacturability of targeted bispecific antibody-like proteins in the context of one therapeutic design cycle.

Example 2

Preparation, Expression and Purification of IgG Tetravalent Bispecific Proteins

Three anti-ErbB3-anti-IGF-1R IgG2 tetravalent bispecific proteins ("ELI-7," "ILE-10" and "ILE-12") and other control proteins for use in the experiments described in Example 3, were prepared essentially as follows. ELI-7, ILE-10 and ILE-12 have the structure IgG2 (scFv)$_2$.

ELI-7 is an anti-ErbB3/anti-IGF-1R IgG2 tetravalent bispecific protein comprising an anti-ErbB3 IgG2 antibody, to which an anti-IGF-1R scFv is linked to each of the C-termini of the heavy chains of the IgG2 protein.

ILE-10 and ILE-12 are anti-IGF-1R/anti-ErbB3 IgG2 tetravalent bispecific proteins comprising an anti-IGF-1R IgG2 antibody, to which an anti-ErbB3 scFv is linked to each of the C-termini of the heavy chains of the IgG2 protein.

The structure and relationships of ELI-7, ILE-10 and ILE-12 are set forth in Table 6. Briefly, they all comprise the same anti-IGF-1R VH sequence ("module 5-7"). ILE-10 and ILE-12 differ only in the sequence of the ErbB3 scFv. ILE-10 and ELI-7 comprise the same anti-IGF-1R and anti-ErbB3 VH sequences, and differ in that ILE-10 has an IGF-1R Fab and an ErbB3 scFv ("ILE") and ELI-7 has the opposite configuration ("ELI"). The control antibodies are monospecific and each comprises a binding site homologous to ones found in the bispecific antibodies.

TABLE 6

Description of proteins used in Examples 2 and 3

| | Anti-IGF-1R module | Anti-ErbB3 module | Orientation |
|---|---|---|---|
| ELI-7 | 5-7 | 2-3 | ErbB3-IGF-1R |
| ILE-10 | 5-7 | 2-3 | IGF-IR-ErbB3 |
| ILE-12 | 5-7 | 2-21 | IGF-1R-ErbB3 |
| Anti-IGF-1R Ab module 5-7 | 5-7 | — | — |
| Anti-ErbB3 Ab module 2-3 | — | 2-3 | — |
| Anti-ErbB3 Ab module 2-21 | — | 2-21 | — |

Much of the disclosures of Examples 2-3 herein, including ELI-7, ILE-10 and ILE-12, are found in PCT application PCT/US2010/052712.

The aa sequences of the light and heavy chains of each of the proteins are as follows: Heavy chain of ELI-7: SEQ ID NO:316. Light chain of ELI-7: SEQ ID NO:317. Heavy chain of ILE-10: SEQ ID NO:318. Heavy chain of ILE-12: SEQ ID NO:319. Light chain of ILE-10 and IL-12: SEQ ID NO:320.

The nucleic acids encoding the proteins (referred to as "fusion proteins") are cloned as single proteins into the expression plasmids using standard recombinant DNA techniques. An expression vector employed is pMP 10K (SELEXIS). Expression plasmids are linearized, purified using QIAquick® purification kit (QIAGEN), and co-transfected into CHO cells using Lipofectamine™ LTX (Invitrogen). Transfected cells are recovered with F12Hams medium containing 10% FBS for 2 days without selection pressure, then with selection pressure for 4 days. After 4 days, they are changed into serum-free medium (Hyclone) containing glutamine with selection pressure. After a week, cells are checked for expression and scaled up to desired volume. All proteins are purified using a combination of three chromatography steps: protein A affinity, cation exchange and anion exchange. Each is carried out in accordance with the manufacturer's instructions. The protein A affinity step is used to selectively and efficiently bind the fusion proteins out of harvested cell culture fluids (HCCF). This removes >95% of product impurities in a single step with high yields and high throughput. The portion of desired molecular form for fusion proteins after this step was in the range of 60 to 98 percent. MABSELECT from GE is used as the Protein A affinity resin. SPFF (sulphopropyl fast flow) from GE, an agarose based resin, is used as the cation exchange resin in the second chromatography step. The portion of desired molecular form for fusion proteins after this step was in the range of 90 to 99 percent. QSFF (Quaternary-amine sepharose fast flow) from GE, an agarose based anion exchange resin, is used in a third and final chromatography step. The purified material was concentrated and dialyzed into PBS. The final yield for the fusion proteins after this step was is in the range of 20 mg-100 mg/L.

Example 3

Binding and Biological Activity of Anti-ErbB3+Anti-IGF-1R IgG Tetravalent Bispecific Proteins This Example shows that an anti-IGF-1R+anti-ErbB3 IgG tetravalent bispecific protein (ELI-7) binds with high affinity to IGF-1R and to ErbB3 (as also shown for two similar proteins ILE-10 and ILE-12), potently inhibits 1) signal transduction from the IGF-1R and ErbB3 receptors, 2) AKT phosphorylation, and 3) tumor cell proliferation in vitro and in vivo. Results were obtained essentially as follows.

A) Binding of ELI-7, ILE-10 and ILE-12 to IGF-1R and ErbB3

$1 \times 10^5$ MCF7 cells or $1 \times 10^5$ ADRr cells are incubated at room temperature for 2 hours with each of ELI-7, ILE-10 and ILE-12, two anti-ErB3 antibodies and one anti-IGF-1R antibody at 2 uM, followed by 12 subsequent 3-fold dilutions. Then using goat anti-HSA-Alexa647 conjugated antibody as the detection antibody, cells are incubated on ice for 40 minutes. Cell binding dissociation constants (measures of binding affinities) of the antibodies on MCF7 and ADRr cells are assessed by FACS and apparent dissociation constants are determined for each protein. The following results were obtained (see also FIGS. 14A and 14B):

TABLE 7

Binding Kds of bispecific proteins

| Inhibitor | Kd (nM) | |
|---|---|---|
| | ADRr (n = 3) | MCF7 (n = 1) |
| ELI-7 | 2.5 | 2.1 |
| ILE-10 | 7.1 | 4.5 |
| ILE-12 | 0.3 | 0.6 |
| Anti-ErbB3 IgG (module 2-21) | 0.4 | 0.04 |
| Anti-ErbB3 Ig (module 2-3) | 1.2 | 0.9 |
| Anti-IGF-1R Ig (module 5-7) | 5.1 | 5.6 |

The results show that IgG-bispecifics (i.e. ELI-7, ILE-10, ILE-12) bound to both cell types, in some cases with greater binding at low concentrations, indicating avid binding and the ability to bind to each receptor. The IgG-bispecifics had a similar Kd to the equivalent monoclonal antibody component.

B) Signal Inhibition of IGF-1R, ErbB3 and Akt by ELI-7 and ILE-7

The ability of ELI-7 and ILE-7 to antagonize IGF-1R and ErbB3 and inhibit activation (phosphorylation) of downstream components, IGF-1R, ErbB3 and Akt; phosphorylation is examined. $3.5 \times 10^4$ BxPC-3 cells are pre-incubated for 1 hour with an antibody at 0.3 µM, followed by 9 subsequent 3-fold dilutions to give a 10-point curve. Cells are treated with IGF-1 at 80 ng/ml and heregulin at 20 ng/ml for 15 minutes. Phosphorylation of IGF-1R to yield phospho-IGF-1R (pIGF-1R) is measured by ELISA (R & D Systems; Cat.# DYC1770) to evaluate the ability of the agents to inhibit pIGF-1R formation. Phosphorylation of ErbB3 is measured by ELISA (R & D Systems; Cat#DYC1769) to evaluate the ability of the agents to inhibit pErbB3 formation. Phosphorylation of AKT is measured by ELISA using the following antibodies: anti-AKT, clone SKB1 (Millipore, Cat.#05-591); biotinylated anti-phospho-AKT (Ser$^{473}$-specific; Cell Signaling Technology Cat.#5102). ILE-7 is a trivalent protein having the same binding sites as ELI-7 and described in PCT/US2010/052712. FIGS. 15A-15C show the results that were obtained essentially as described above for ILE-7 and ELI-7. The results that were obtained are also summarized in the table below.

TABLE 8

Inhibition of phosphorylation of ErbB3, IGF-1R and AKT by ELI-7

| | Ki (nM) | |
|---|---|---|
| | ELI-7 | ILE-7 |
| pAKT | 6.3 | 1.3 |
| pErbB3 | 1.3 | 0.6 |
| pIGF-1R | 14.1 | 0.8 |

The results show that ELI-7 inhibits phosphorylation of ErbB3, IGF-1R and Akt, even with simultaneous stimulation with IGF-1 and HRG.

C) Cell Growth Inhibition by ELI-7 in Two Dimensional Culture

The effect of ELI-7 on tumor cell proliferation is examined in vitro using a CTG assay, which is a luminescence-based assay that measures the amount of cellular ATP present (Promega; Cat.# PR-G7572), indicated as Relative Light Units (RLU). 500 cells per well of DU145 cells are incubated for 6 days in medium with 80 ng/ml IGF-1 and 20 ng/ml HRG and containing a 3-fold dilution of inhibitors starting at 2 uM. The control consists of DU145 cells incubated without growth factors or antibodies.

Results obtained essentially as described above indicate that the ELI-7 inhibited the growth of DU145 cells (Ki=12 nM, see FIG. 16), whereas inhibitors of either IGF-1R or ErbB3 had no effect on cell growth.

A similar experiment was conducted on another cell line. 2000 BxPC-3 cells per well are incubated for 6 days in medium containing a 3-fold dilution of inhibitors starting at 1 uM. The control consists of IgG2 Kappa from human myeloma plasma" (Sigma Aldrich catalog #I5405).

Results obtained essentially as described above indicate that ELI-7 inhibited BxPC-3 growth by 46% (p<0.001, Student's T-test) (FIG. 17).

D) Tumor Growth Inhibition by Bispecific Proteins in Human Xenograft Mouse Models of Cancer This example shows that ELI-7 inhibits tumor growth in mouse models of cancer in two different models.

First the pharmacokinetic properties of each bispecific protein in mice was calculated. 600 ug of ELI-7 or 500 ug of each HSA-linked trivalent control protein (ILE-3, ILE-7, and ILE-9; described in PCT/US2010/052712) was injected via tail vein into each mouse (4 mice per inhibitor and time point). Blood was drawn at various time points thereafter (mice were first sacrificed and then blood was drawn by cardiac puncture). Time points for ELI-7 are: 0.5, 4, 24, 72, 120, 168 and 240 hours. Time points for trivalent control proteins are: 0.5, 4, 8, 24, 28, 72, and 120 hours. For ELI-7, blood concentration is measured using an anti-human IgG ELISA kit (Bethyl labs Cat.# E80-104) according to the manufacturer's instructions. For the trivalent proteins, concentration in the blood is measured using an ELISA kit that detects IGF-1R and ErbB3 binding specifically, plates are coated with His-tagged human IGF-1R, incubated with the trivalent proteins or ELI-7, then detected with a human ErbB3-Fc (R&D Systems) and an anti-Fc-HRP detection reagent. Pharmacokinetic properties (half-life and Cmax) for each protein are calculated using a one-compartment model. The following results were obtained:

TABLE 9

Half-life and Cmax of ELI-7 in mouse blood

| Antibody | Half life (hours) | Cmax (ug/ml) |
|---|---|---|
| ELI-7 | 48 | 612 |
| ILE-3 | 15 | 410 |
| ILE-7 | 14 | 516 |
| ILE-9 | 17 | 447 |
| anti-IGF-1R IgG (module 5-7) | 124 | 517 |
| anti-ErbB3 IgG (module 2-3) | 58 | 645 |

Simulation of drug-specific half-lives led to prediction that the following doses would result in equal exposure (or in the case of ILE-7 50% comparable exposure):

TABLE 10

Predicted dose for equal exposure

| Table 10 | Dose (ug) |
|---|---|
| ELI-7 | 600 |
| ILE-7 | 800 |

TABLE 10-continued

Predicted dose for equal exposure

| Table 10 | Dose (ug) |
|---|---|
| anti-IGF-1R IgG (module 5-7) | 300 |
| anti-ErbB3 IgG (module 2-3) | 500 |

The effect of ELI-7 on human pancreatic cancer xenograft tumor growth in mouse models was then assessed by injecting 5×10$^6$ BxPC-3 cells (resuspended in a 1:1 mixture of PBS and growth factor-reduced matrigel; BD Biosciences Cat.#354230) into the subcutaneous space in the flank of each mouse. Tumors were allowed to develop for 7-10 days (until they reached a volume of approximately 100-200 mm$^3$), and then tumor size was measured for each mouse (pi/6×length× width$^2$, where width is the smallest measurement). Mice were then size-matched and then randomly assigned into treatment groups. ELI-7, a trivalent control protein (ILE-7), an anti-ErbB3 antibody, an anti-IGF-1R antibody or a PBS control was then injected every 3 days until the completion of the study.

The results, (FIGS. 18 and 19), show that ELI-7 significantly inhibited the xenograft tumor growth of BxPC-3 tumors compared to the PBS control: final tumor volume was 77% lower in ELI-7 treated tumors compared to the PBS control (p values determined by student's T-test). Day 0 refers to the first day of dosing.

The effect of ELI-7 on human prostate cancer xenograft tumor growth in a mouse model was assessed by injecting 5×10$^6$ DU145 cells (resuspended in a 1:1 mixture of PBS and growth factor-reduced matrigel; BD Biosciences Cat.#354230) into the subcutaneous space in the flank of each mouse. Tumors were allowed to develop for 7-10 days (until each reached a volume of approximately 100-200 mm$^3$), and then tumor size was measured for each mouse (pi/6×length× width$^2$, where width is the smallest measurement). Mice were then tumor-size-matched and then randomly assigned into the treatment groups. ELI-7, a trivalent control protein (ILE-7), an anti-ErbB3 antibody, an anti-IGF-1R antibody or a PBS control was then injected every 3 days until the completion of the study.

The results, (FIGS. 20A and 20B), show that ELI-7 significantly inhibited xenograft tumor growth of DU145 cells, whereas the control anti-IGF-1R and anti-ErbB3 antibodies did not: the final tumor volume was 50% lower in ELI-7 treated tumors compared to the PBS control (p values determined by student's T-test). Day 0 refers to the first day of dosing.

E) ELI-7 Inhibits Signaling Across a Broad Range of ErbB3 and IGF-1R Receptor Levels To determine whether ELI-7 can inhibit downstream signaling across a broad range of ErbB3 and IGF-1R receptor levels the following experiment was performed:

BxPC-3 cell receptor levels are varied by shRNA-mediated knockdown of IGF-1R or ErbB3 in BxPC-3 cells using the pLKO.1 PURO vector (Sigma). The shRNA sequences are provided in PCT/US2010/052712. ErbB3 and IGF-1R levels are then measured by quantitative FACS and the mean receptor levels are calculated from the resulting distribution (see Table 11 for relative expression levels). To determine the potency of ELI-7, cells are serum-starved and pretreated with ELI-7 for 1 hour at 37° C., followed by a 15-minute stimulation with 20 ng/ml HRG+80 ng/ml IGF1. Signal inhibition is assessed by ELISA for pAKT.

The results indicate that ELI-7 displayed similar potency across the BxPC-3 cells lines with modified receptor levels as indicated by their IC50 values and overlapping confidence intervals (see Table 11), indicating that ELI-7 has broad activity against a range of receptor profiles (FIG. 21).

TABLE 11

Relative receptor levels and pAkt IC50 values for four BxPC-3 cell lines:

| Engineered BxPC-3 cell line | % of control receptor level | pAkt IC50 | 95% Confidence Interval | Sigma-Aldrich Catalog # |
|---|---|---|---|---|
| BxPC-3-non-targeted control | IGF-1R and ErbB3 levels unchanged | 3.6 nM | 0.9-14.7 nM | SHC002V |
| BxPC-3-IGF-1R-mod.1 | IGF-1R level reduced by 37% | 6.4 nM | 2.9-14.1 nM | SHCLNV-NM_000875-TRCN0000039673 |
| BxPC-3-ErbB3-mod.1 | ErbB3 level reduced by 48% | 3.3 nM | 1.4-8.0 nM | SHCLNV-NM_001982-TRCN0000230091 |
| BxPC-3-ErbB3-mod.2 | ErbB3 level reduced by 88% | 7.6 nM | 1.2-50.0 nM | SHCLNV-NM_001982-TRCN0000018327 |

Example 4

Biological Activity of an Anti-IGF-1R/Anti-ErbB3 Tetravalent Bispecific Protein with Enhanced Activities (16F) Relative to ELI-7

The proof of concept protein (ELI-7) described in Examples 2 and 3 was further improved to increase its binding affinity to IGF-1R and ErbB3, biological activity, stability and solubility; as described in Example 1. The following changes were made: (i) the orientation was switched from anti-ErbB3 as the IgG component to anti-IGF-1R as the IgG component; (ii) an anti-ErbB3 binding moiety binding to a different epitope was used; (iii) its CDR3 VH region was affinity matured; (iv) the anti-IGF-1R IgG component was mutated to stabilize it (stabilizing mutations) and (v) its backbone was switched from IgG2 to IgG1. The resulting protein is 16F, whose aa sequences are of FIG. 7.

The increase in anti-IGF-1R potency of 16F relative to that of ELI-7, as a function of inhibition of IGF-1R phosphorylation, is measured as described in Example 3. The results that were obtained essentially as described above, (FIG. 22), indicate that the reengineered protein is a significantly more potent inhibitor of IGF-1R signal transduction.

The potency of inhibition of signal transduction through ErbB3 and through inhibition of AKT phosphorylation is measured essentially as described in Example 3 for 16F, ELI-7 and a combination of ANTI-IGF-1R Ab# A (ganitumab; SEQ ID 327+SEQ ID 328) and anti-ErbB3 Ab# A (SEQ ID 336+SEQ ID 337). These measurements are carried out in BxPC-3 cells in the presence of HRG and IGF1. The results that were obtained essentially as described above, (Table 12), indicate that 16F has improved efficacy in inhibiting signal transduction compared to ELI-7, which efficacy is comparable to that of a combination of the clinical grade inhibitors ANTI-IGF-1R Ab# A+anti-ErbB3 Ab# A.

TABLE 12

Comparison of 16F with Eli-7 and clinical-grade inhibitors

| Inhibitor | pErbB3 IC50 (nM) | pIGF-1R IC50 (nM) | pAKT IC50 (nM) |
|---|---|---|---|
| ELI-7 | 3.7 | 10 | 9.4 |
| 16F | 0.5 | 1.1 | 2.5 |
| ANTI-IGF-1R Ab# A (ganitumab; SEQ ID NO: 327 + SEQ ID NO: 328) + ANTI-ErbB3 Ab# A (SEQ ID NO: 336 + SEQ ID NO: 337) | 0.8 | 0.9 | 2.2 |

As described in Example 1, it was also shown that the re-engineered bispecific, i.e., 16F, is more thermal and serum stable than ELI-7. In addition, 16F is less prone to aggregation: (i) 16F is stable at 19 mg/ml in PBS at 4° C., with only about 2% aggregation in 33 days; (ii) no significant change in % monomers was observed after 3 freeze thaw cycles; (iii) no significant change in % monomers was observed after shaking at 4° C. for one day; and (iv) no significant change in % monomers was observed on incubation at 37° C. for 6 days.

Results from additional comparative experiments described below also show that 16F is at least as effective as a combination of commercial anti-IGF-1R and anti-ErbB3 in inhibiting signal transduction.

In a first set of experiments, the effectiveness of 16F (SF-G1-C8) in inhibiting the phosphorylation IGF-1R, ErbB3 or AKT was compared to that of the Anti-IGF-1R Ab#B (cixutumumab; SEQ ID 324+SEQ ID 325), Anti-ErbB3 Ab# A (SEQ ID 336+SEQ ID 337) or Anti-IGF-1R Ab#B+Anti-ErbB3 Ab# A in two different cell lines (BxPC-3 and DU145).

BxPC-3 and DU145 cells are maintained in RPMI-1640 medium supplemented with 10% fetal bovine serum, Penicillin/Streptomycin and L-glutamine. For signaling experiments, $3.5 \times 10^4$ cells are plated in complete medium in 96-well tissue culture plates. The following day, complete medium is replaced with serum-free medium, and cells are incubated overnight at 37° C. Cells are pretreated for 1 hour with the indicated doses of antibody, and then stimulated for 15 minutes with 100 ng/ml IGF-1 (Calbiochem) and 30 ng/ml HRG (R&D Systems). Cells are washed with PBS and lysed in MPer buffer supplemented with protease and phosphatase inhibitors.

ELISAs for phospho-IGF-1R (pIGF-1R) and phospho-ErbB3 (pErbB3) are preformed according to the manufacturer's protocols (R&D Systems). An ELISA for phospho-AKT (pAKT) is performed with the following reagents: anti-AKT capture antibody (Millipore), anti-pAKT (Ser473) detection antibody (Cell Signaling), and streptavidin-HRP (R&D Systems). SUPERSIGNAL ELISA PICO chemiluminescent substrate (Pierce) is added and plates read on a PerkinElmer En Vision® plate reader. Luminescence values are plotted and IC50 values calculated using Graphpad Prism 5 software.

The results, which were obtained essentially as described above and are shown in FIG. 23 (BxPC-3 cells) and FIG. 24 (DU145 cells) and in Table 13, indicate that 16F shows surprisingly more potent inhibition of dual pathway signaling through pErbB3 and pAKT than the combination of anti-IGF-1R Ab# B and anti-ErbB3 Ab# A.

TABLE 13

IC50 values for inhibitor treatments presented in FIG. 23.

| Cell Line | Inhibitor | pIGF-1R IC50 | pErbB3 IC50 | pAKT IC50 |
|---|---|---|---|---|
| BxPC-3 | 16F (SF-G1-C8) | 7.7E−10 | 2.4E−10 | 2.3E−09 |
| BxPC-3 | Anti-IGF-1R Ab# B (cixutumumab; SEQ ID NO: 324 + SEQ ID NO: 325) | 2.4E−09 | ND | 1.4E−08 |
| BxPC-3 | ANTI-ErbB3 Ab# A (SEQ ID NO: 336 + SEQ ID NO: 337) | ND | 5.1E−11 | 3.9E−10 |
| BxPC-3 | ANTI-IGF-1R Ab# B + ANTI-ErbB3 Ab# A | 1.9E−09 | 3.2E−10 | 3.2E−09 |
| DU145 | 16F (SF-G1-C8) | 1.1E−09 | 2.0E−10 | 5.1E−10 |
| DU145 | Anti-IGF-1R Ab# B (cixutumumab; SEQ ID NO: 324 + SEQ ID NO: 325) | 9.1E−10 | ND | 9.8E−09 |
| DU145 | ANTI-ErbB3 Ab# A (SEQ ID NO: 336 + SEQ ID NO: 337) | ND | 8.2E−11 | 2.8E−10 |
| DU145 | ANTI-IGF-1R Ab# B + ANTI-ErbB3 Ab# A | 1.0E−09 | 3.2E−10 | 9.3E−10 |

In a second set of experiments, the effectiveness of 16F (SF-G1-C8) in inhibiting the phosphorylation IGF-1R, ErbB3 or AKT was compared to that of the anti-IGF-1R antibody ANTI-IGF-1R Ab# A, the anti-ErB3 antibody anti-ErbB3 Ab# A, or a combination of the latter two antibodies in BxPC-3 cells.

The results, which were obtained essentially as described above and are shown in FIG. 24 and Table 14, indicate surprisingly more potent inhibition of dual pathway signaling through pErbB3 and pIGF-1R by 16F than by the combination of ANTI-IGF-1R Ab# A and anti-ErbB3 Ab# A.

TABLE 14

IC50 values for inhibitor treatments presented in FIG. 24.

| Inhibitor | pErbB3 IC50 | pIGF-1R IC50 | pAKT IC50 |
|---|---|---|---|
| 16F (SF-G1-C8) | 5.0E−10 | 1.1E−09 | 2.5E−09 |
| ANTI-IGF-1R Ab# A (ganitumab; SEQ ID NO: 327 + SEQ ID NO: 328) | ND | 1.5E−10 | 2.6E−10 |
| ANTI-ErbB3 Ab# A (SEQ ID NO: 336 + SEQ ID NO: 337) | 4.3E−10 | ND | 5.7E−09 |
| ANTI-IGF-1R Ab# A + ANTI-ErbB3 Ab# A | 8.2E−10 | 9.3E−10 | 2.2E−09 |

Example 5

Binding and Biological Activity of Additional Anti-IGF-1R/Anti-ErbB3 IgG Tetravalent Bispecific Antibodies Comprising the SF Module Additional anti-IGF-1R+anti-ErbB3 IgG tetravalent bispecific antibodies were constructed. Each of these PBAs was assembled by combining three modules, essentially as shown in FIG. 8. Each PBA comprises a pair of heavy chain fusion polypeptides (each comprising at least a part of each of the three modules), each member of the heavy chain pair being bound to the other and each further being bound to one of a pair of light chains. The three modules assembled into each PBA are:
1. an N-terminal (amino terminal) Fab variable domain module comprising both (essentially identical) light chains and the N-termini of both heavy chains;
2. an scFv module; and
3. a HC IgG CR module interposed between the N-terminal Fab variable domain module and the scFv module.

The heavy chains being fusion polypeptides comprise the heavy chain portion of the N-terminal Fab module, an IgG CR module and the C-terminal scFv module.

The new anti-IGF-1R+anti-ErbB3 antibodies were made of a combination of the anti-IGF-1R and anti-ErbB3 moieties of Table 15, assembled as modules arranged in differing orientations. For each of Tables 15 and 16, each PBA that was built comprises a fusion protein comprising a pair of essentially identical heavy chain polypeptides, each comprising a combination, in N-terminal to C-terminal (amino to carboxy) order, of each Fab module named in the left column with an IgG1 CR (G1) and with any one scFv module named in the right column of the same Table. The aa sequences of the heavy and light chains of these additional PBAs are of FIG. 5A (anti-IGF-1R+anti-ErbB3) and FIG. 5B (anti-ErbB3 and anti-IGF-1R).

TABLE 15

Anti-IGF-1R-anti-ErbB3 proteins

| Anti-IGF-1R Fab | Anti-ErbB3 scFv |
|---|---|
| SF | C8 |
| P4 | P1 |
| M78 | M1.3 |
| M57 | M27 |
|  | P6 |
|  | B69 |

TABLE 16

Anti-ErbB3-anti-IGF-1R proteins

| Anti-ErbB3 Fab | Anti-IGF-1R scFv |
|---|---|
| P1 | P4 |
| M27 | M78 |
| M7 |  |
| B72 |  |
| B60 |  |

This example shows that the antibodies that comprise an N-terminal "SF" module bind BxPC-3 cells, bind ErbB3, inhibit IGF-1R, ErbB3 and AKT phosphorylation, and are stable. Results obtained with the other proteins are of Example 6.

A) BxPC-3 Cell Binding Data

Binding of SF-G1-P1, SF-G1-P6, SF-G1-M27, SF-G1-B69, SF-G1-M1.3 and SF-G1-C8 (16F) to BxPC-3 was measured essentially as follows.

BxPC-3 cells are maintained in RPMI-1640 medium supplemented with 10% fetal bovine serum, Penicillin/Streptomycin and L-glutamine. Medium was removed and the BxPC-3 cells were washed with PBS. Trypsin is added until the cells detached from the plate, and then neutralized with medium+10% serum. The cells are spun down and resuspended in FACS buffer (1X PBS+2% Serum+0.1% Azide). Aggregates are broken down into single cells by pipetting up and down and putting the cells through a cell strainer. The cells are spun down and resuspended in FACS buffer at a density of $2 \times 10^6$ cells/ml. In a 96 well conical bottom plate, 50 ul of cell suspension is aliquotted per well to give $10^5$ cells/well.

Antibodies are diluted to 1 uM in FACS buffer, and 10 3-fold dilutions are done, with a final well consisting of FACS buffer only (no primary antibody). 50 ul of antibodies are added to 50 ul of cells so that the highest final antibody concentration is 500 nM in the first well. Cells and antibodies are incubated at room temperature with gentle agitation for 2 hrs. The plates are spun at 1,500 RPM for 5 min, and the supernatant is removed. Pellets are washed three times in FACS buffer. After the final wash the FACS buffer is removed, and 50 ul of ant-Fc-DyLight 649 secondary antibody (Abcam) added at 1:100 in FACS buffer. Cells are incubated in the cold room in the dark with gentle agitation for 1 hour, washed again three times and resuspended in 100 ul fixing buffer (PBS with 1% Paraformaldehyde, 2% FBS). The samples are transferred to 96 well U-bottom FACS plates (Becton Dickinson) and kept in the dark at 4 degrees until use. Samples were read using a FACSCalibur (Becton Dickinson), and Median Fluorescent Intensities (MFI) were determined using FlowJo. The analysis was performed with GraphPad PRISM, using a log (agonist) vs response (three parameter) non-linear regression curve fit.

The results (FIG. 25) and in Table 17, indicate that these bispecific antibodies display strong binding to BxPC-3 cells.

TABLE 17

EC50 values for bispecific antibody binding presented in FIG. 25.

| Bispecific Antibody | EC50 (nM) |
|---|---|
| SF-G1-C8 | 3.1 |
| SF-G1-P1 | 4.9 |
| SF-G1-P6 | 2.9 |
| SF-G1-M27 | 2.7 |
| SF-G1-B69 | 2.1 |
| SF-G1-M1.3 | 3.5 |

B) ErbB3 Binding Data

Binding of SF-G1-P1, SF-G1-P6, SF-G1-M27, SF-G1-B69, SF-G1-M1.3 and SF-G1-C8 (16F) to recombinant ErbB3 was measured essentially as follows.

96-well REACTI-BIND plates (Pierce) are coated with 50 ul of ErbB3-His (ErbB3 with a C-terminal hexa-histidine tag—2 ug/ml in PBS) ("hexa-histidine" disclosed as SEQ ID NO:403) and incubated overnight at 4° C. The next day plates are washed with PBS+0.05% Tween-20 (PBS-T) and blocked for 1 hr. at room temperature with 100 ul of Protein-Free Blocking Buffer (Pierce). Plates are washed with PBS-T and 50 ul of each bispecific antibody is added in duplicate. Concentrations start at 500 nM (in PBS-T) and include ten additional two-fold dilutions and one blank (PBS-T only). Plates are incubated at room temperature for two hours and then washed with PBS-T. 50 ul of anti-Fc-HRP (Jackson Labs) is added at 1:40,000 in PBS-T, and plates are incubated in the dark for 1 hr. at room temperature. Plates are again washed with PBS-T and 100 ul of TMB substrate (Thermo Scientific, TMB and peroxide solution mixed 1:1) added. The plates are incubated for 5-15 minutes at room temperature until a blue color develops, and the reaction is stopped with 100 ul of STOP solution (Cell Signaling Technology). The absorbance was read at 450 nm on a PerkinElmer Envision plate reader, and binding curves were generated with GraphPad PRISM, using a log (agonist) vs response (three parameter) non-linear regression curve fit.

The results (FIG. 26 and Table 18), indicate that the bispecific antibodies display strong binding to recombinant ErbB3 protein.

TABLE 18

EC50 values for bispecific antibody binding presented in FIG. 26.

| Bispecific Antibody | EC50 (nM) |
|---|---|
| SF-G1-C8 | 0.3 |
| SF-G1-P1 | 0.4 |
| SF-G1-P6 | 0.3 |
| SF-G1-M27 | 0.4 |
| SF-G1-B69 | 0.4 |
| SF-G1-M1.3 | 0.2 |

C) Inhibition of Signal Transduction

Inhibition of signal transduction by SF-G1-P1, SF-G1-P6, SF-G1-M27, SF-G1-B69, SF-G1-M1.3 and SF-G1-C8 (16F) was measured essentially as follows.

BxPC-3 cells are maintained in RPMI-1640 media supplemented with 10% fetal bovine serum, Penicillin/Streptomycin and L-glutamine. $3.5 \times 10^4$ cells are plated in complete medium in 96-well tissue culture plates. The following day, complete medium is replaced with serum-free medium, and cells incubated overnight at 37° C. Cells are pretreated for 1 hour with the indicated doses of drug, and then stimulated for 15 minutes with 100 ng/ml IGF1 (Calbiochem) and 30 ng/ml HRG (R&D Systems). Cells are washed with PBS and lysed in MPer buffer ("Mammalian Protein Extraction Reagent" Pierce Thermo Scientific) supplemented with protease and phosphatase inhibitors.

ELISAs for phospho-IGF1R (pIGF1R) phospho-ErbB3 (pErbB3) and phospho-AKT (pAKT) are preformed as described in Example 4, above. Relative luminescence units (RLU) were plotted and IC50 values calculated using Graphpad Prism 5 software.

The results (FIG. 27 and Table 19), indicate that the bispecific proteins strongly inhibit dual pathway signaling.

TABLE 19

IC50 values and percent inhibition values for inhibitor treatments shown in FIG. 27.

| Inhibitor | pIGF1R IC50 | pIGF1R % Inhibition |
|---|---|---|
| SF-G1-P6 | 8.2E−10 | 91.2 |
| SF-G1-M1.3 | 8.0E−10 | 87.9 |
| SF-G1-B69 | 1.2E−09 | 91.1 |
| SF-G1-P1 | 9.2E−10 | 91.3 |
| SF-G1-M27 | 6.0E−10 | 90.7 |
| SF-G1-C8 | 9.5E−10 | 93.0 |

TABLE 19-continued

IC50 values and percent inhibition values for inhibitor treatments shown in FIG. 27.

| Inhibitor | pErbB3 IC50 | pErbB3 % Inhibition |
|---|---|---|
| SF-G1-P6 | 2.9E−10 | 96.6 |
| SF-G1-M1.3 | 2.5E−10 | 97.0 |
| SF-G1-B69 | 5.2E−10 | 97.8 |
| SF-G1-P1 | 6.9E−10 | 95.3 |
| SF-G1-M27 | 2.5E−10 | 98.1 |
| SF-G1-C8 | 2.4E−10 | 94.9 |

| Inhibitor | pAKT IC50 | pAKT % Inhibition |
|---|---|---|
| SF-G1-P6 | 1.9E−09 | 75.6 |
| SF-G1-M1.3 | 1.2E−09 | 77.4 |
| SF-G1-B69 | 2.7E−09 | 72.7 |
| SF-G1-P1 | 2.4E−09 | 71.7 |
| SF-G1-M27 | 1.4E−09 | 73.8 |
| SF-G1-C8 | 1.5E−09 | 72.3 |

D) Stability of the Bispecific Proteins

Various stability studies have been performed and they show that SF-G1-P1, SF-G1-P6, SF-G1-M27, SF-G1-B69, SF-G1-M1.3 are stable in serum, are thermally stable, and are stable at low pH.

For determining serum stability, the proteins are incubated in mouse serum (Sigma) at a final concentration of 2.5 uM for either 0 hr or 72 hrs at 37° C. The samples are then assayed using the colorimetric ELISA binding assay described above, and binding curves are generated with GraphPad Prism. Absorbance values are normalized to 0 hr at the inflection point of each curve to determine the percent binding retained after 72 hrs in serum at 37° C.

Results that were obtained essentially as described above, (FIG. 28), indicate that each of the PBAs tested has a (normalized) serum stability after 72 hours of at least 70%. Certain PBAs have a stability of about 100%.

For determining thermal stability, EC90 values were calculated for each PBA using the binding curves generated in the ELISA binding experiment described above. Each PBA is prepared at 5X its EC90 value in PBS and transferred to PCR plates (Bio-Rad) at 50 ul per well. The plates are spun down and placed in the ICYCLER IQ gradient PCR machine (Bio-rad) to heat the antibodies for 1 hr from 47-72° C. Aliquots of each antibody are also kept at 25° C. and 37° C. for 1 hr. The plates are then spun down at 2,000 RPM for 5 minutes, and supernatants are diluted five-fold in PBS-T to their EC90 concentration. The samples are then assayed using the colorimetric ELISA binding assay described above, and absorbances are normalized to 25° C. Binding curves were generated with GraphPad Prism to determine $T_{50}$ values.

Results that were obtained essentially as described above, (Table 20), indicate that the $T_{50}$ values vary from 46.7° C. to 62.6° C.

TABLE 20

$T_{50}$ values for each bispecific antibody incubated at 25-72° C. for 1 hr

| Bispecific Antibody | $T_{50}$ |
|---|---|
| SF-G1-C8 | 62.1° C. |
| SF-G1-P1 | 46.7° C. |
| SF-G1-P6 | 62.4° C. |
| SF-G1-M27 | 56° C. |
| SF-G1-B69 | 62.6° C. |
| SF-G1-M1.3 | 46.7° C. |

The temperature at which the PBAs unfold was determined by Differential Scanning Fluorimetry (DSF). The DSF assay is performed in the IQ5 Real Time Detection System (Bio-Rad). 20 ul solutions of 15 uM bispecific antibody, 1× Sypro Orange (Invitrogen Life Technologies), and 1×PBS were added to the wells of a 96 well plate. The plate was heated from 20° C. to 90° C. with a heating rate of 1° C./min. Data was transferred to GraphPad Prism for analysis.

Results that were obtained essentially as described above, (Table 21), indicate that the proteins unfold at different temperatures.

TABLE 21

$T_m$ values for each bispecific antibody, as determined by DSF

| Bispecific Antibody | $T_m$ |
|---|---|
| SF-G1-C8 | 69° C. |
| SF-G1-P1 | 54° C. |
| SF-G1-P6 | 61° C. |
| SF-G1-M27 | 55° C. |
| SF-G1-B69 | 61° C. |
| SF-G1-M1.3 | 64° C. |

For determination of pH 3 stability, SF-G1-C8 stock solution is diluted into 0.1 M acetic acid (pH 3.0) and incubated for 1 hour. The solution is then neutralized with 1M Tris Base, dialyzed against PBS and concentrated. The dialysate is tested by SEC (Size Exclusion Chromatography) and colorimetric ELISA against a sample of SF-G1-C8 neutralized immediately after protein A purification. SEC is performed using Agilent 1100 Series HPLC system. 50 ug of SF-G1-C8 is injected on a TSK Super SW3000 gel column (Tosoh Biosciences, P/N 18675). PBS is used as running and equilibration buffer at a flow rate of 0.35 ml/min. The ELISA is performed as described above, coating the plates with either recombinant IGF1R-His or ErbB3-His.

Results that were obtained essentially as described above indicate that SF-G1-C8 is stable, with binding to IGF1R and ErbB3-His substantially unaffected, after low pH incubation (pH 3) for 1 hour.

For determining the stability of SF-G1-C8 for an extended time at 4° C., SF-G1-C8 (19 mg/ml) was incubated in PBS at 4° C. for either 1, 6 or 33 days and subjected to SEC. Percent monomer was determined by SEC as described above. The results indicate that SF-G1-C8 displays 98% stability after 33 days at 4° C.

Example 6

Characterization of Additional Anti-IGF-1R/ErbB3 and Anti-ErbB3/IGF-1R PBAs

A) Binding to BxPC-3 Cells

Binding of PBAs to BxPC-3 cells is determined as follows. BxPC-3 cells are maintained in RPMI-1640 media supplemented with 10% fetal bovine serum, Penicillin/Streptomycin and L-glutamine. Medium is removed and the BxPC-3 cells are washed with PBS. Trypsin is added until the cells detached from the plate, and is then neutralized with media+ 10% serum. The cells are spun down and resuspended in FACS buffer (1X PBS+2% Serum+0.1% azide). Aggregates are broken down into single cells by pipetting up and down and putting the cells through a cell strainer. The cells are spun down and resuspended in FACS buffer at a density of $1 \times 10^6$ cells/ml. In a 96 well conical bottom plate, 50 ul of cell suspension is aliquotted per well to give $5 \times 10^4$ cells/well.

PBAs are diluted to 2 uM in FACS buffer, and 10 3-fold dilutions are done, with a final well consisting of FACS buffer only (no primary antibody). 50 ul of the serially diluted antibodies are added to 50 ul of cells so that the highest final antibody concentration is 1 uM in the first well. Cells and antibodies are incubated at room temperature with gentle agitation for 2 hrs. The plates are spun at 1,500 RPM for 5 min, and the supernatant removed. Pellets are washed three times in FACS buffer. After the final wash the FACS buffer is removed, and 50 ul of anti-Fc-DyLight 649 secondary antibody (Abeam) is added at 1:100 in FACS buffer. Cells are incubated in the cold room in the dark with gentle agitation for 1 hour, washed again three times, and resuspended in 100 ul fixing buffer (PBS with 1% Paraformaldehyde, 2% FBS). The samples are transferred to 96 well U-bottom FACS plates (Becton Dickinson) and kept in the dark at 4 degrees until use. Samples were read using a FACS Calibur (Becton Dickinson), and Median Fluorescent Intensities (MFI) were determined using FlowJo. One Site—Total Binding was used to determine EC50 values with GraphPad PRISM.

Results that were obtained essentially as described above and are shown in FIG. 29 (A-C) and in Table 22 below, indicate that the PBAs display strong binding to BxPC-3 cells. FIG. 29(D) and Table 22 below display the binding data analyzed using a One Site—Total Binding curve fit.

TABLE 22

EC50 values from the separate binding experiments presented in each of FIGS. 29A-D

Figure 29A:
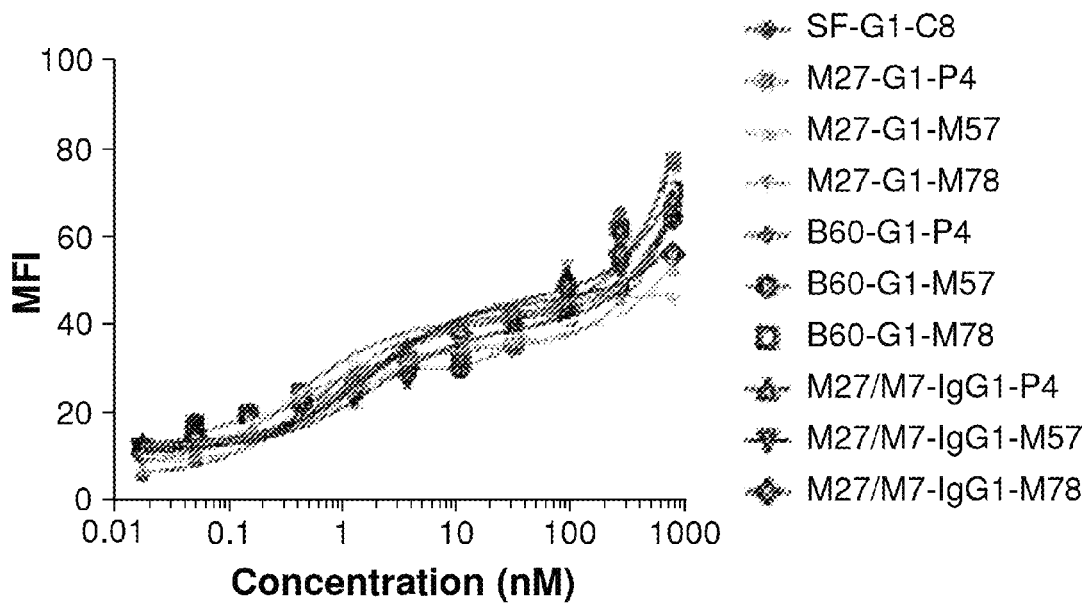
Figure 29B:
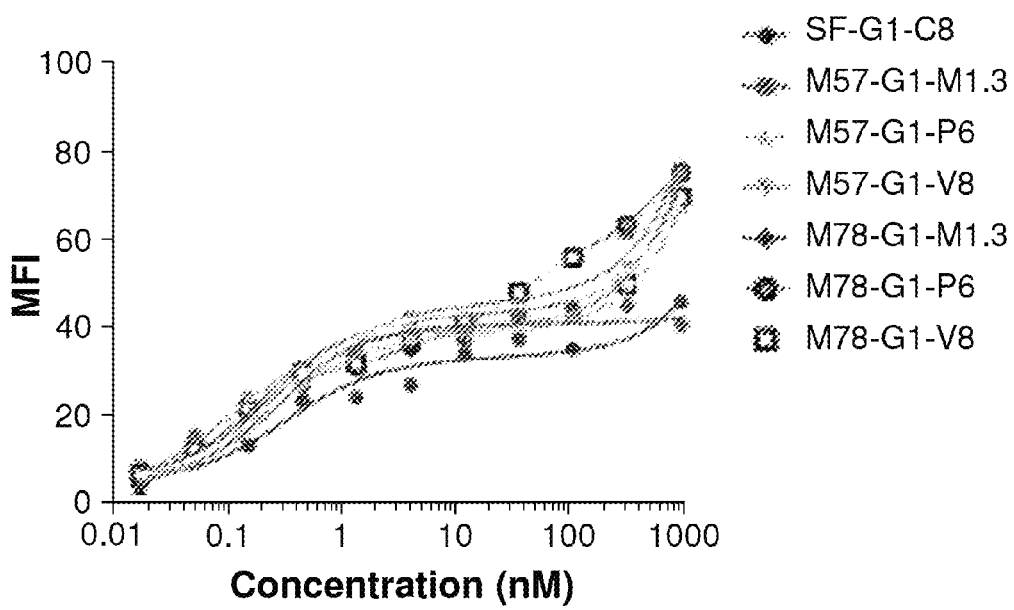
Figure 29C:
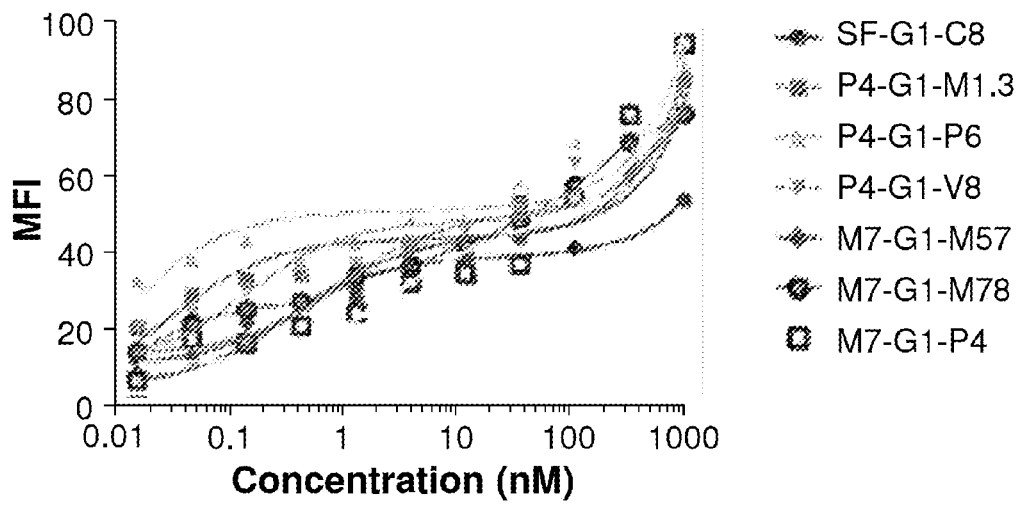
Figure 29D:
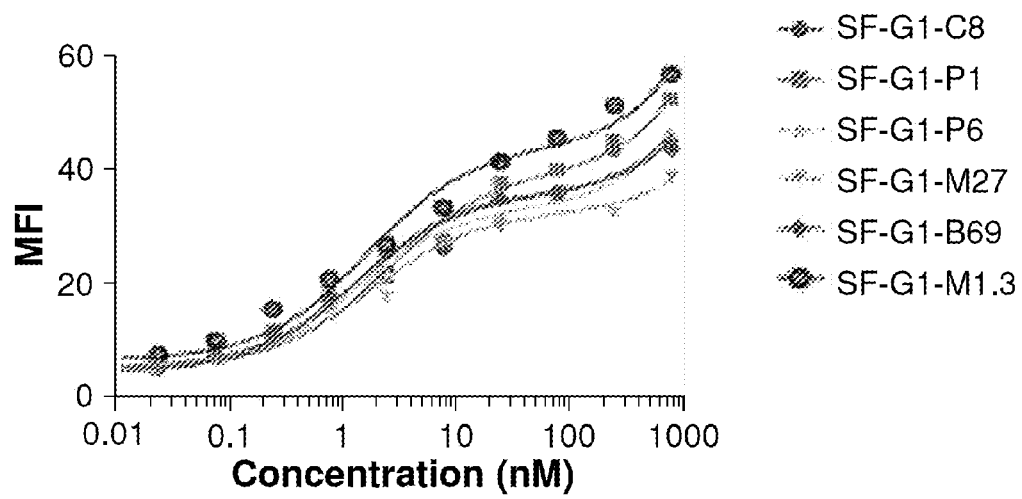
Figure 30A:
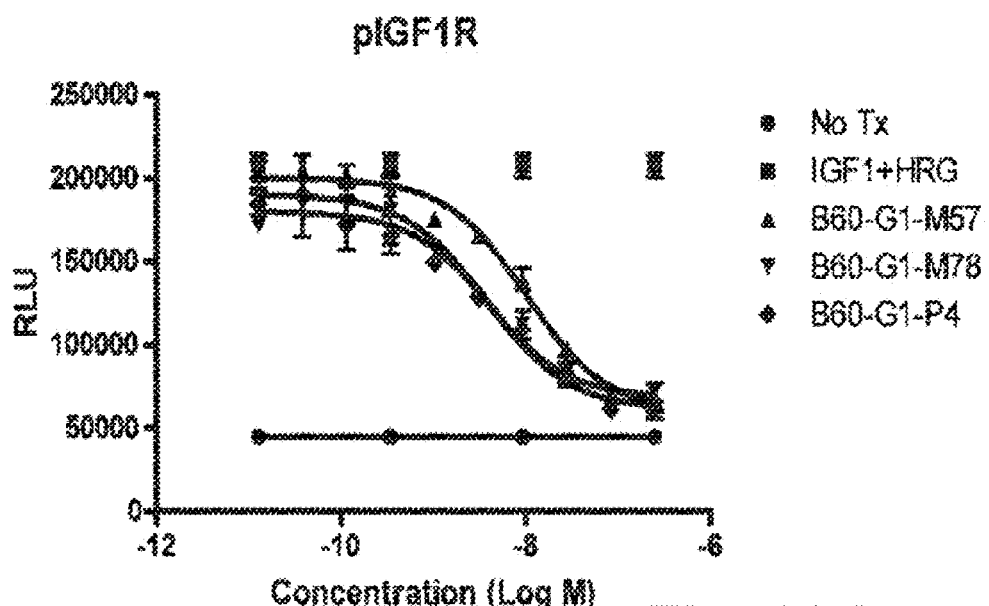
Figure 30B:
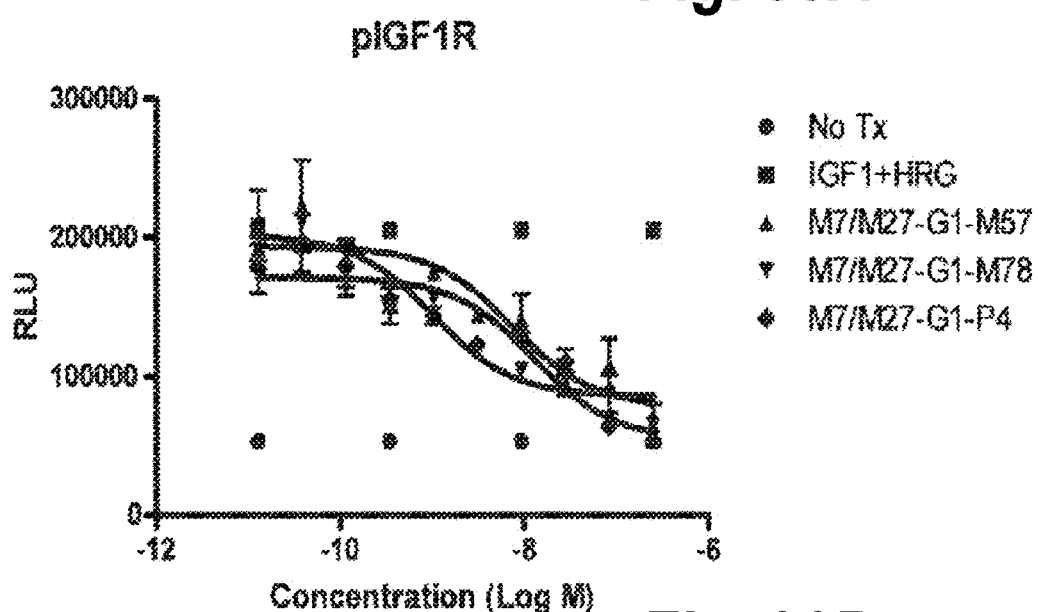
Figure 30C:
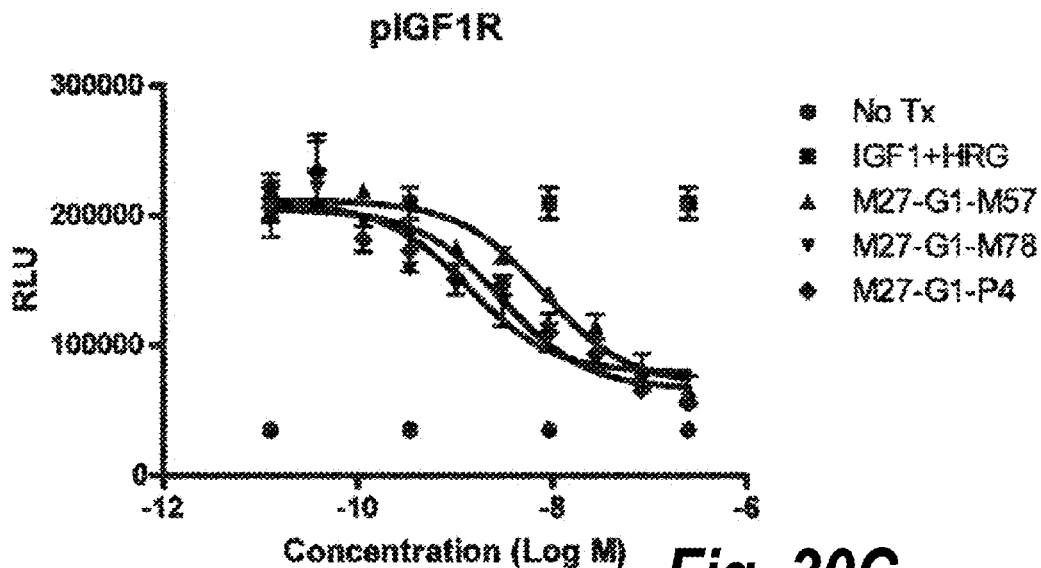
Figure 30D:
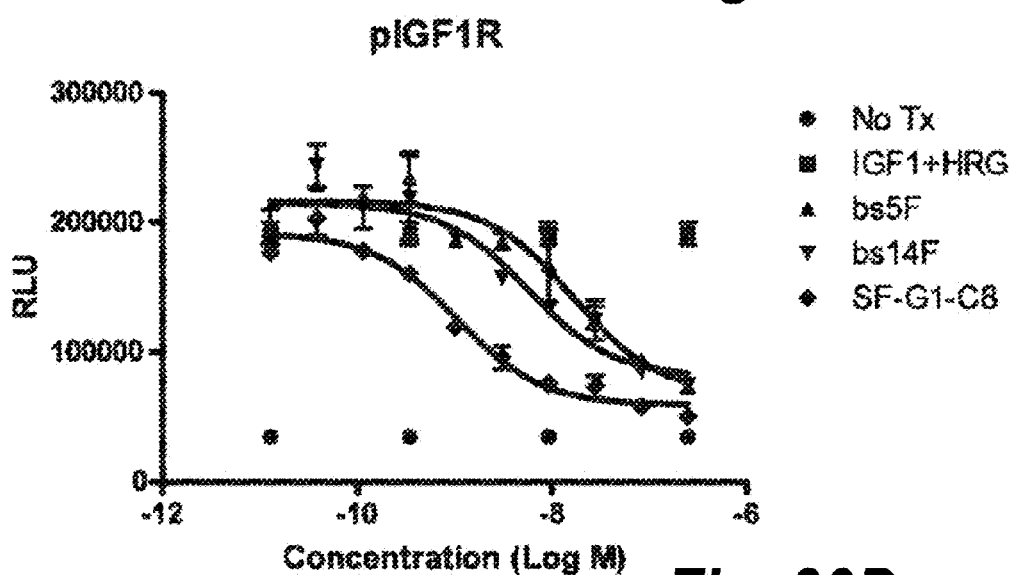
Figure 30E:
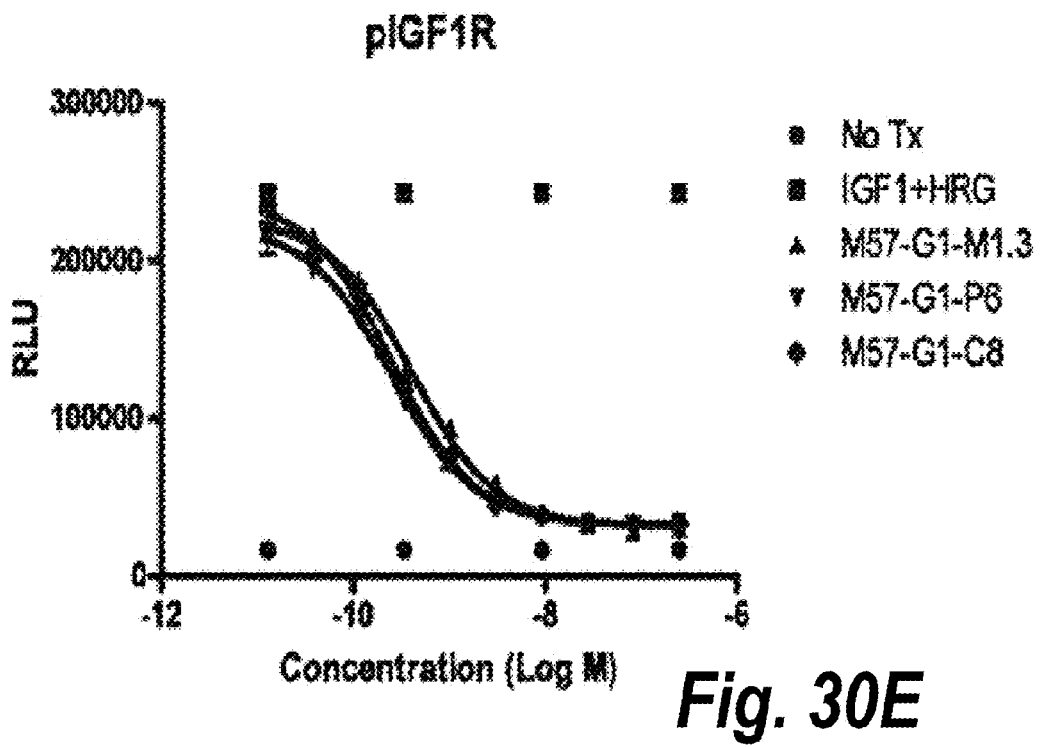
Figure 30F:
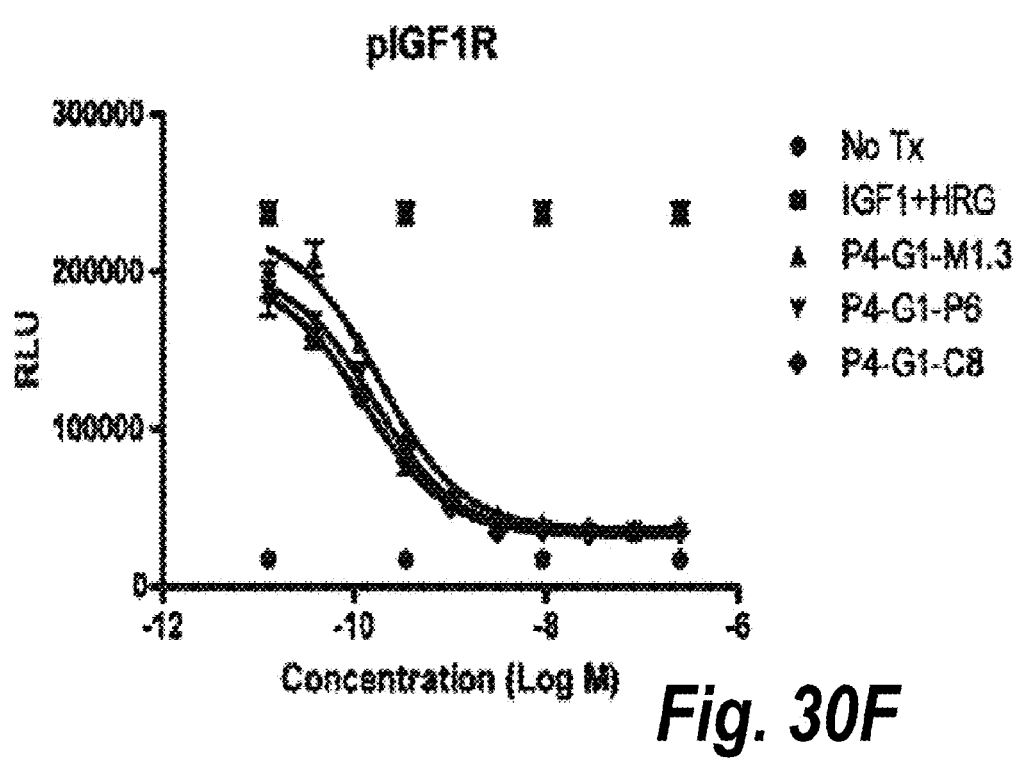
Figure 30G:
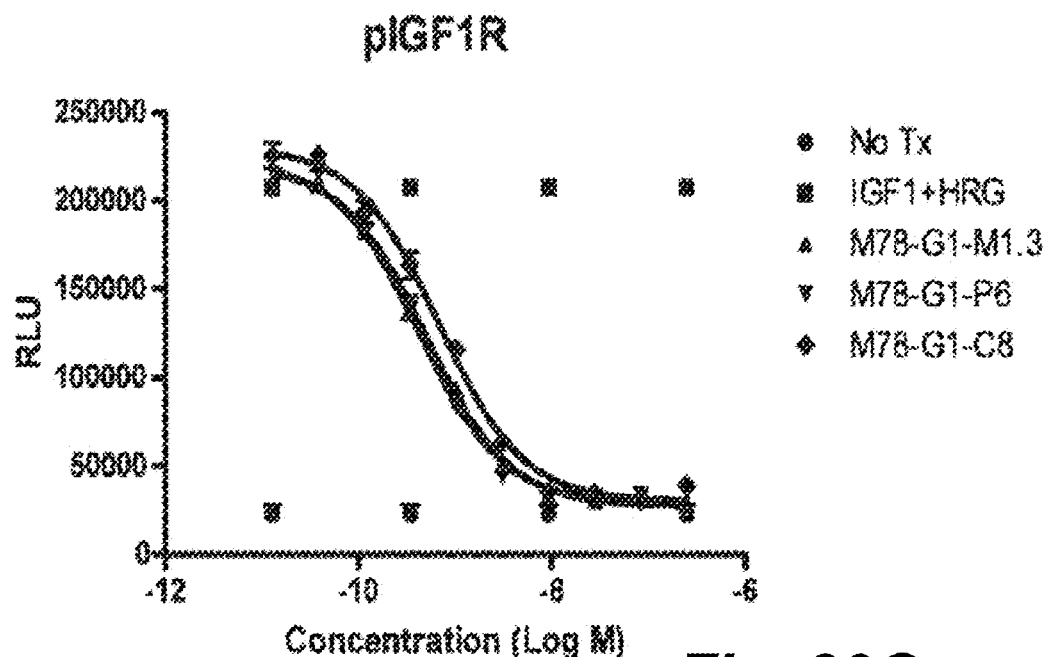
Figure 30H:
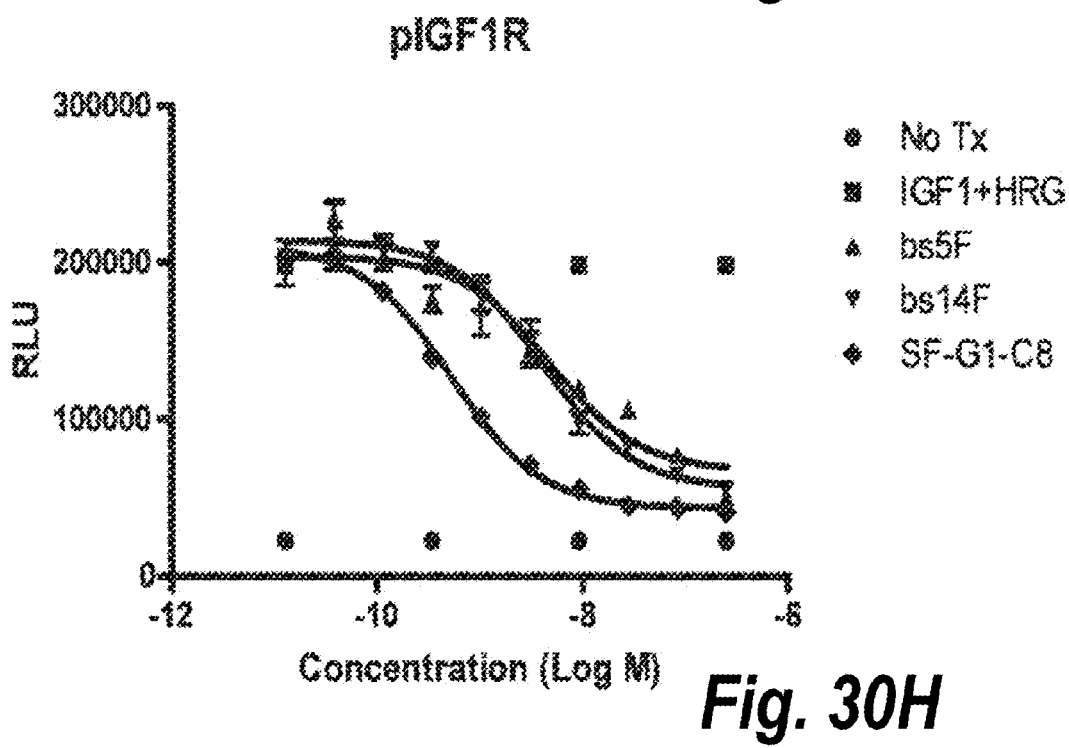
Figure 30I:
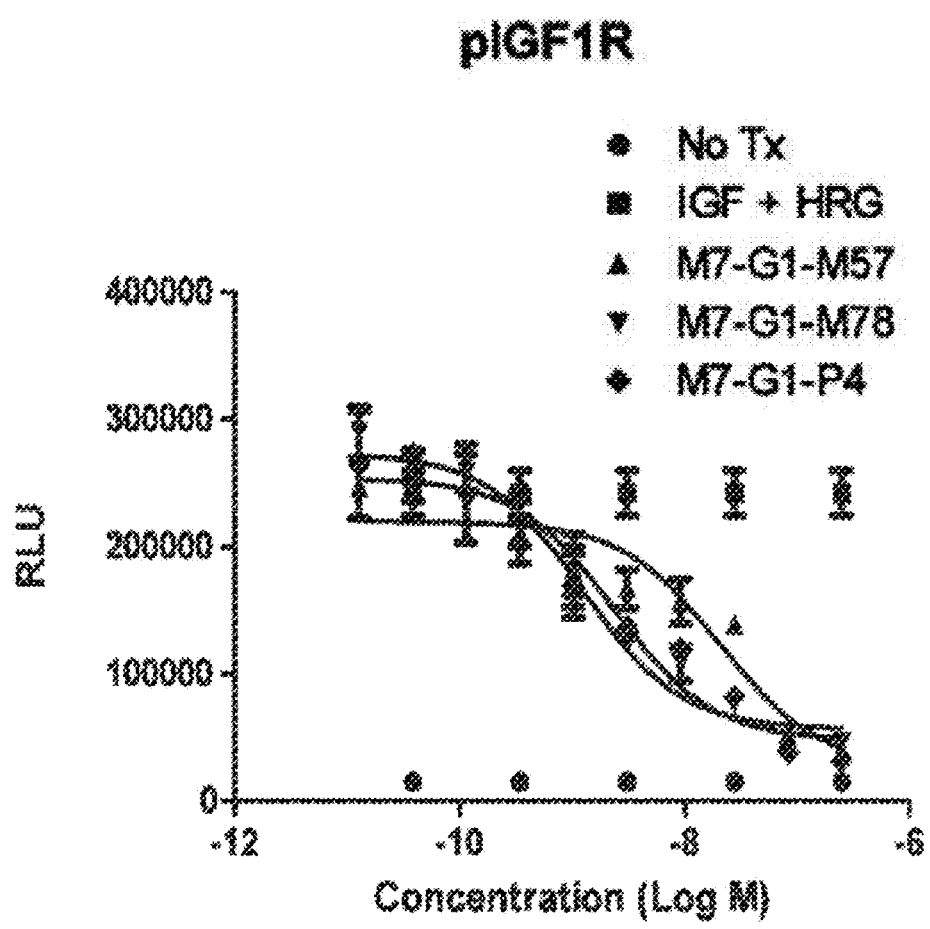
Figure 31A:
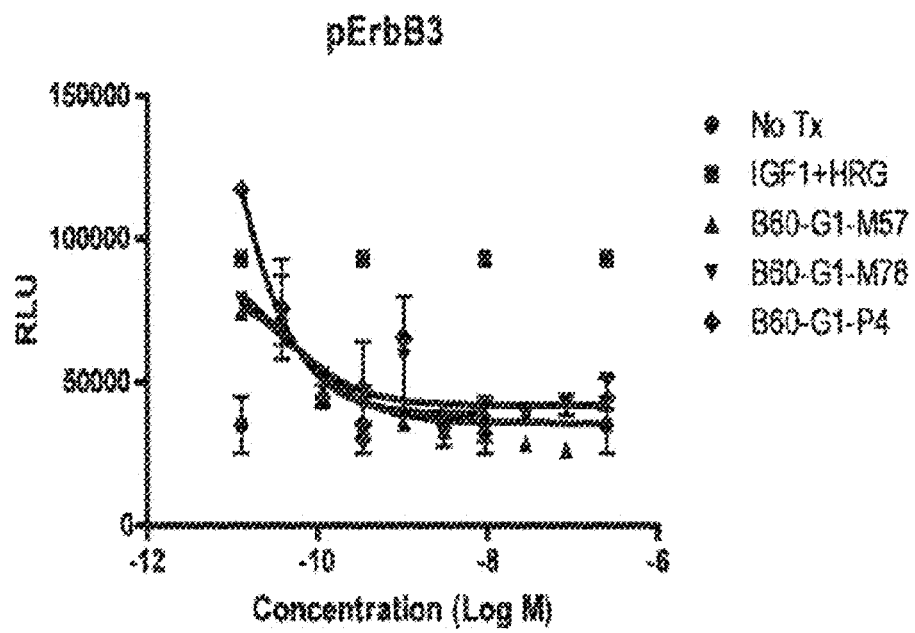
Figure 31B:
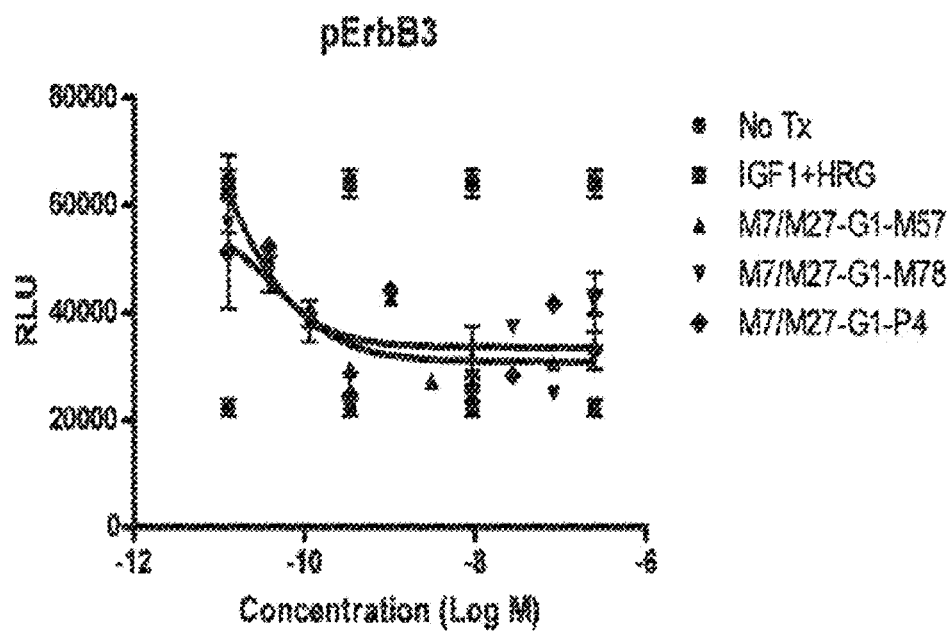
Figure 31C:
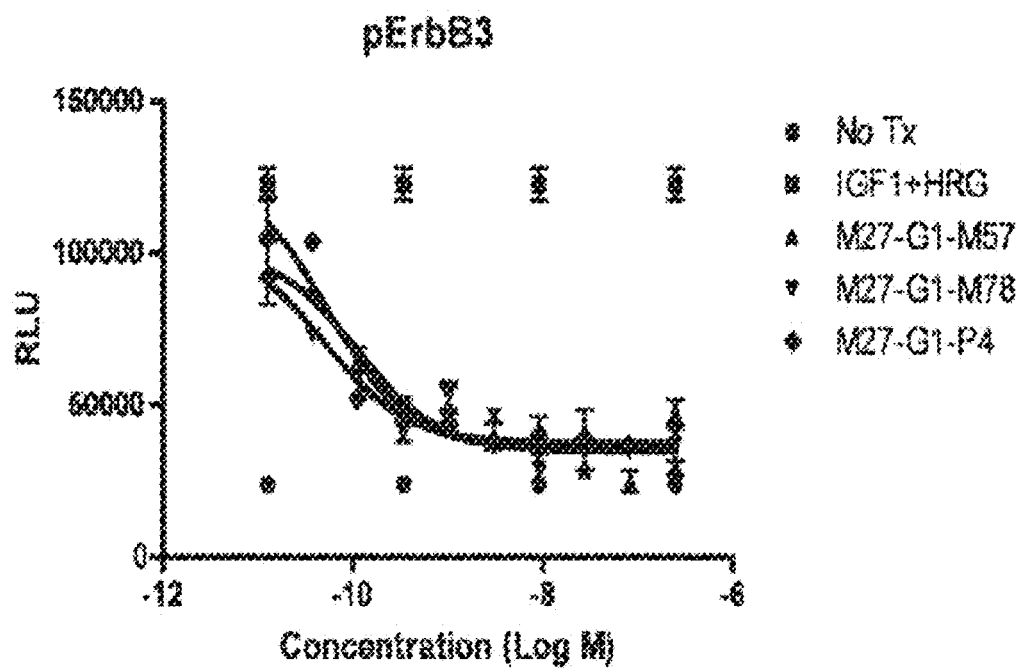
Figure 31D:
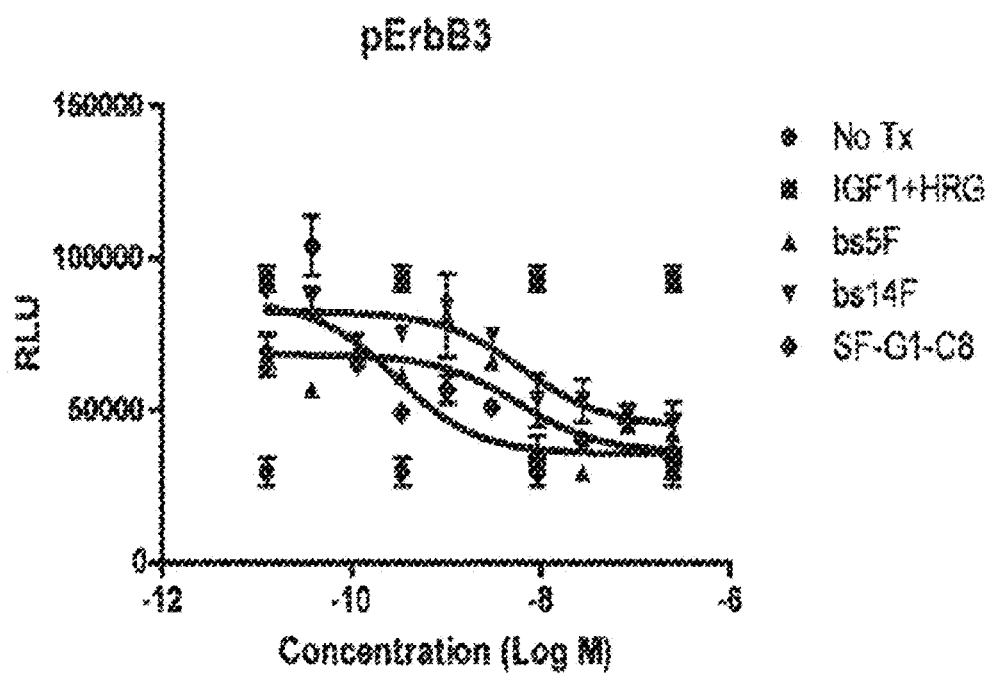
Figure 31G:
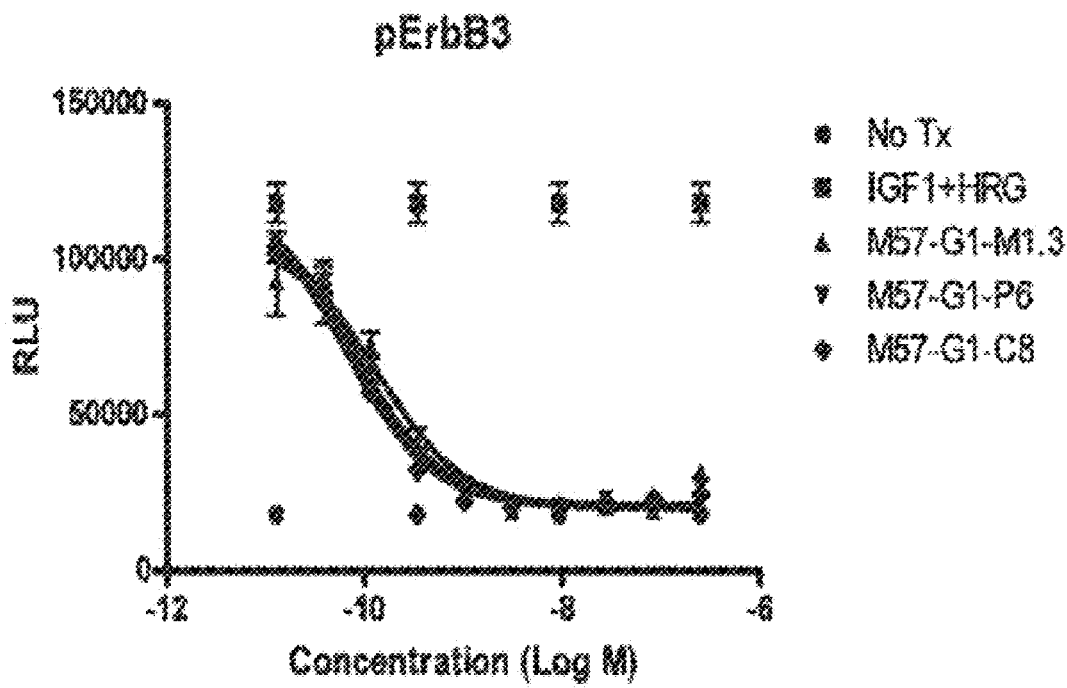
Figure 31H:
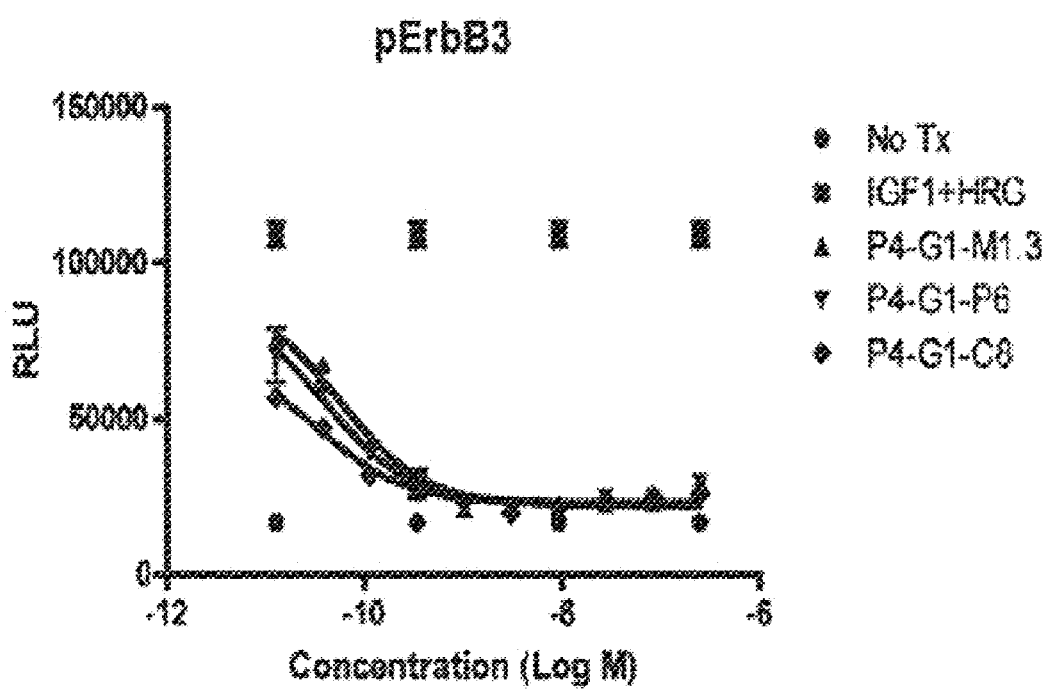
Figure 31I:
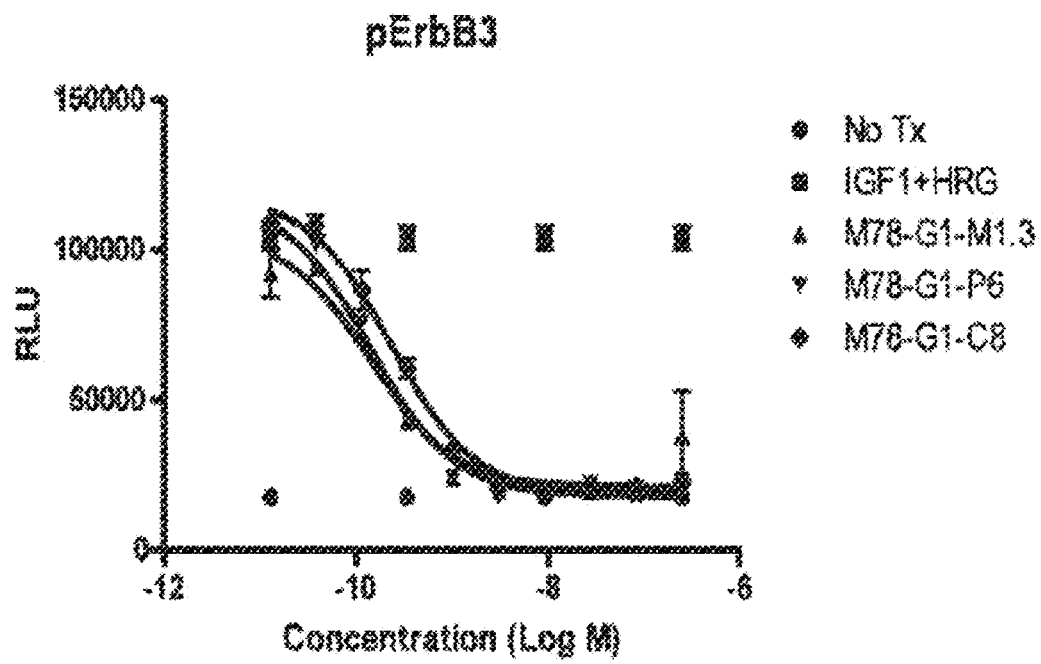
Figure 31J:
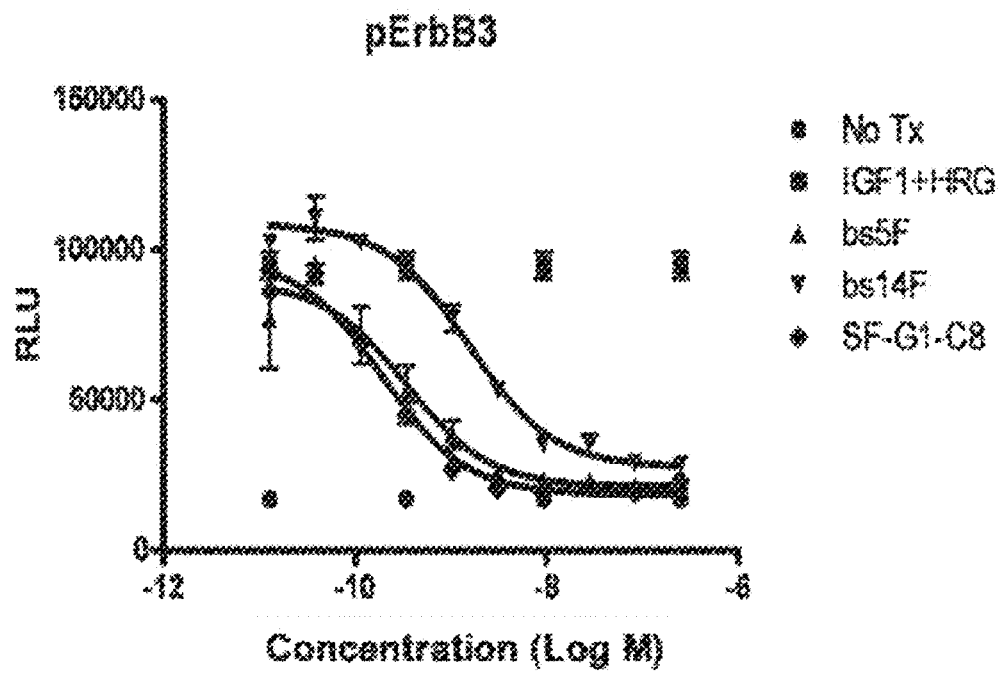
Figure 31K:
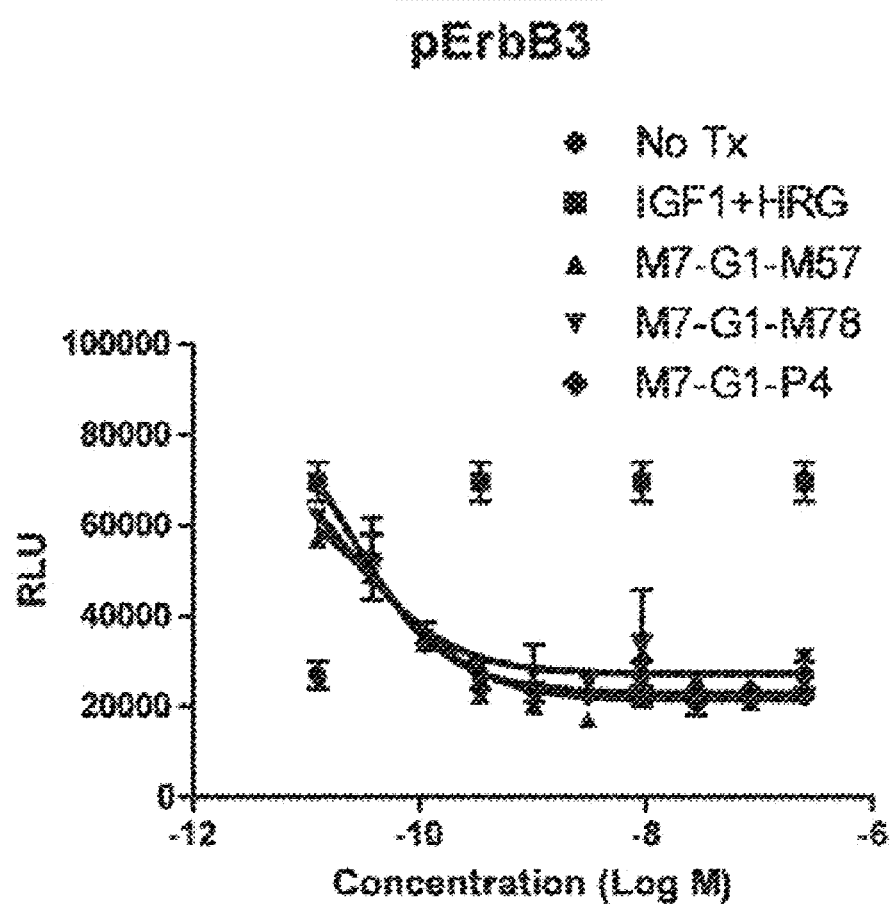
Figure 32A:
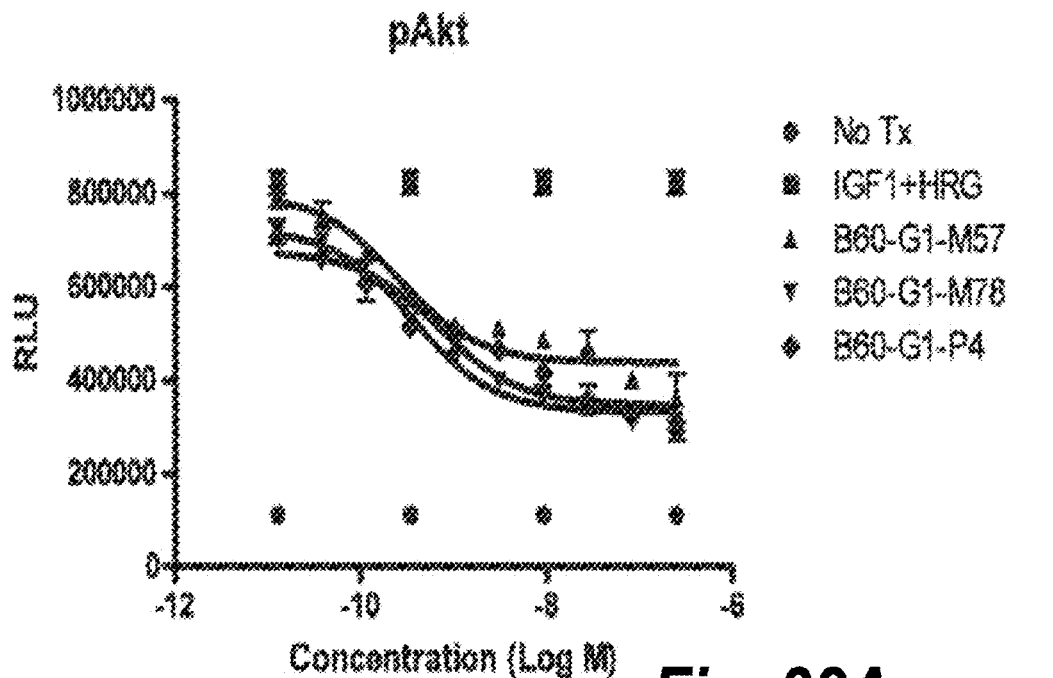
Figure 32B:
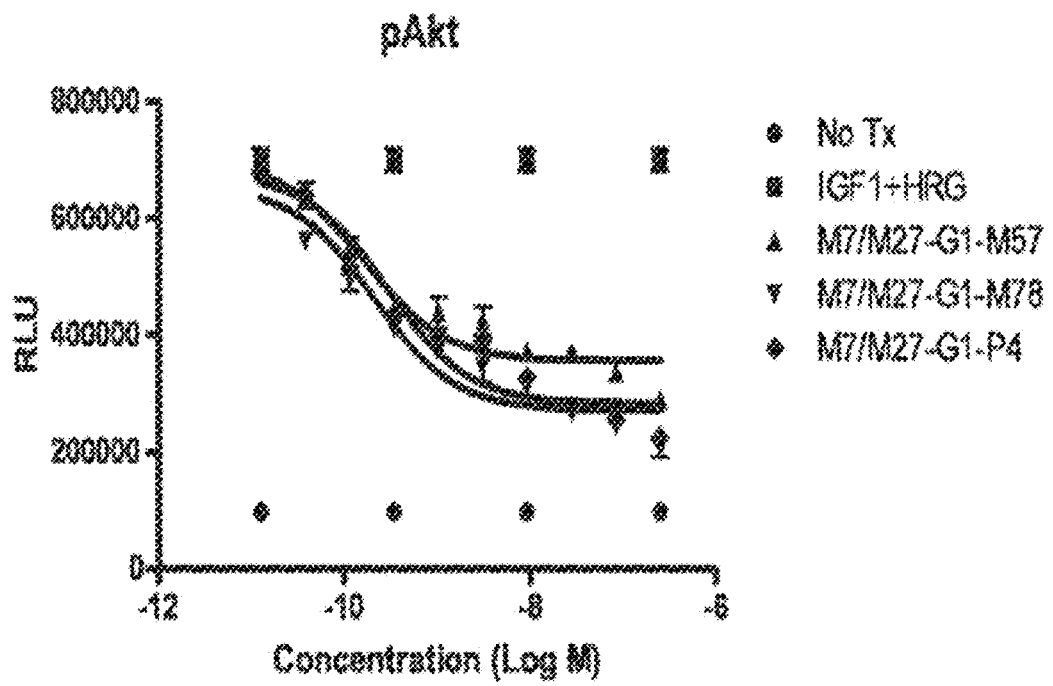
Figure 32C:
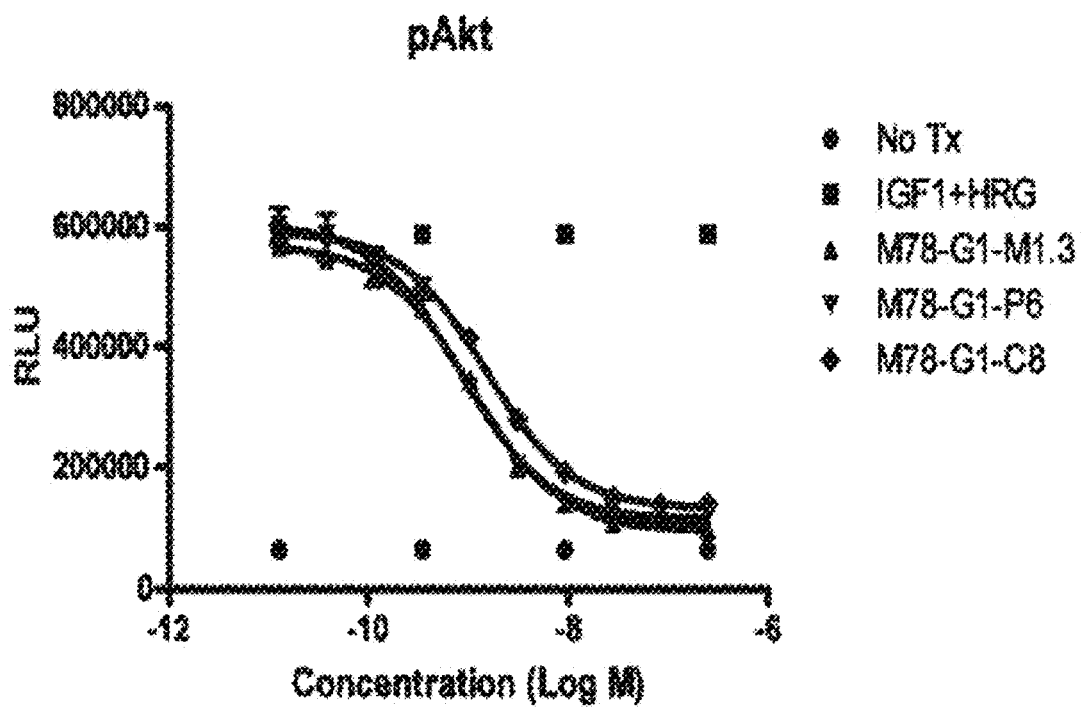
Figure 32D:
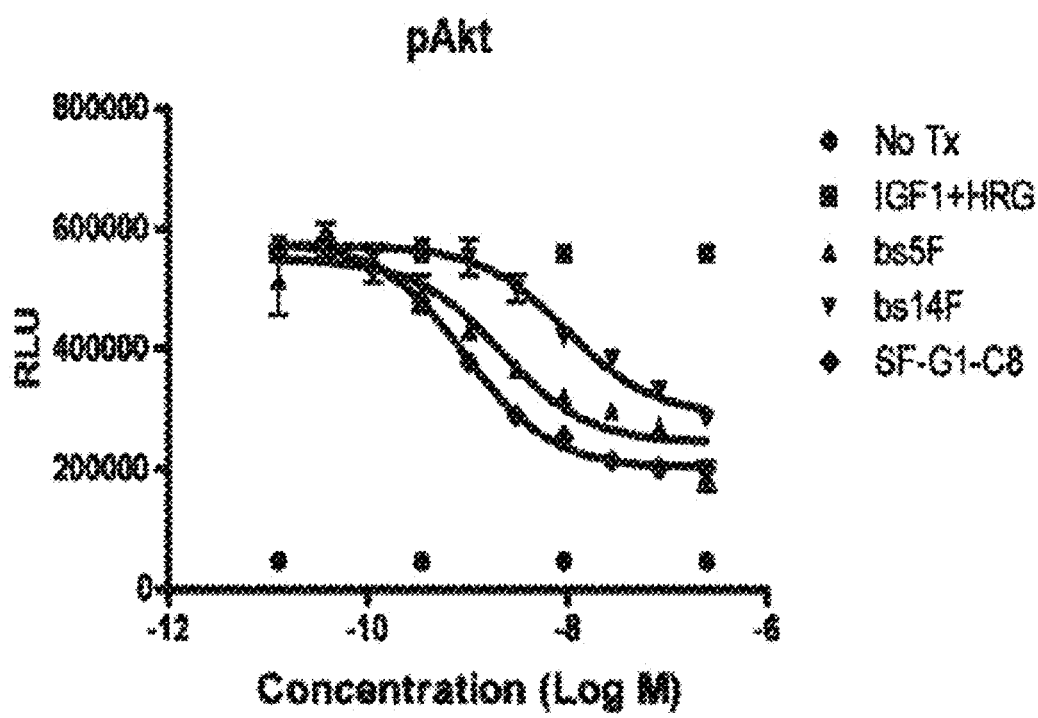
Figure 32E:
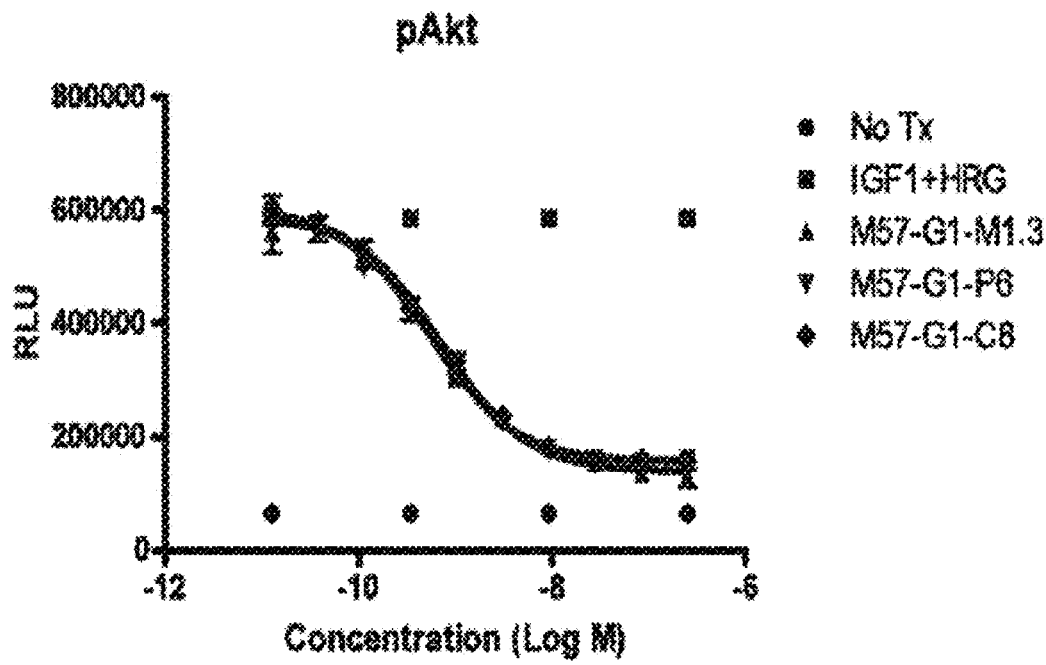
Figure 32F:
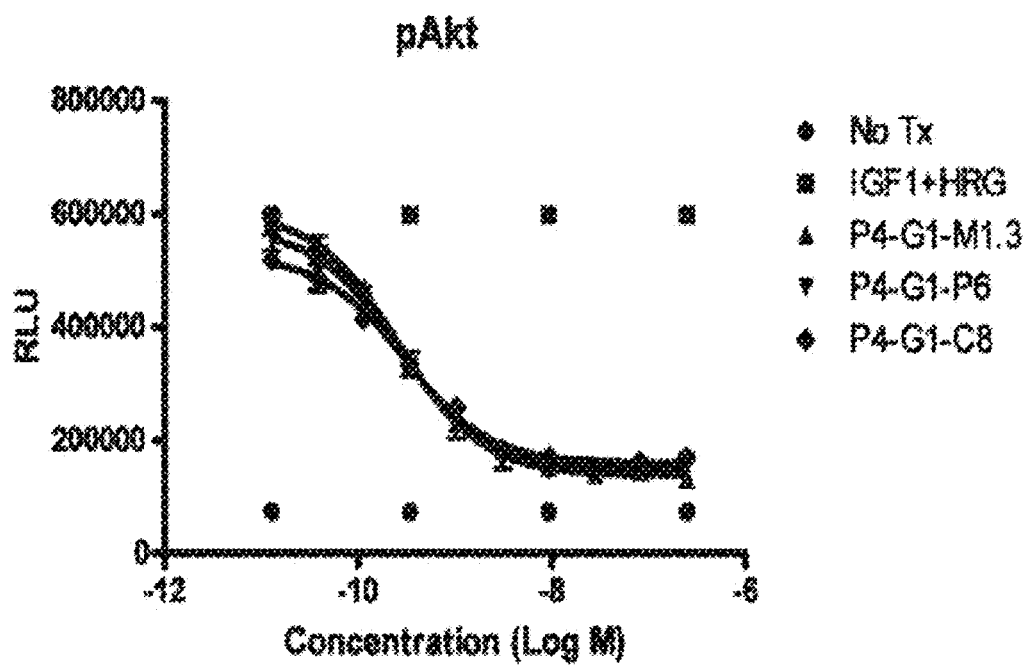
Figure 32G:
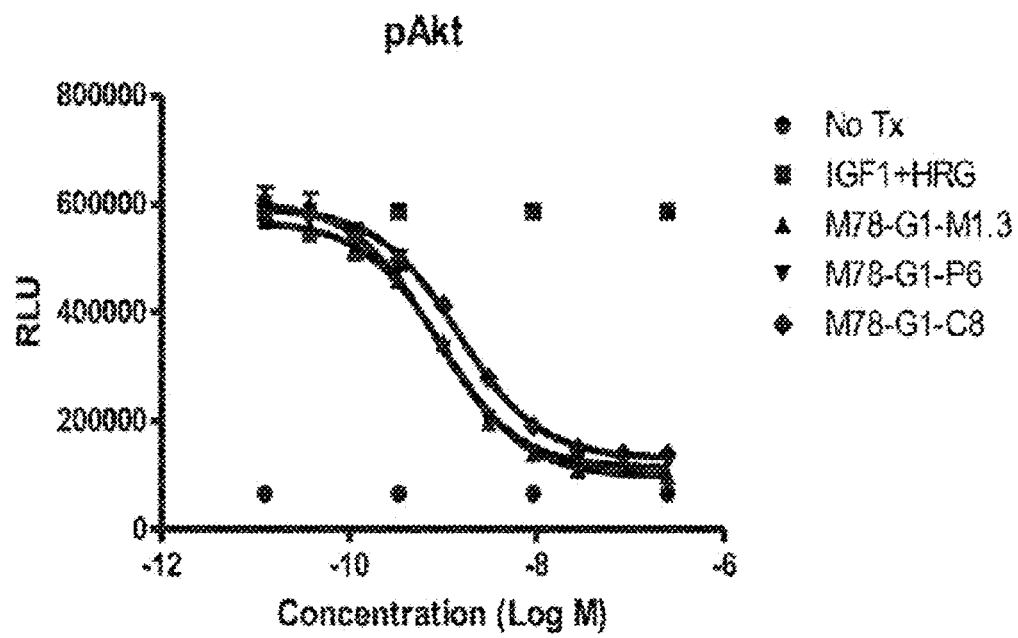
Figure 32H:
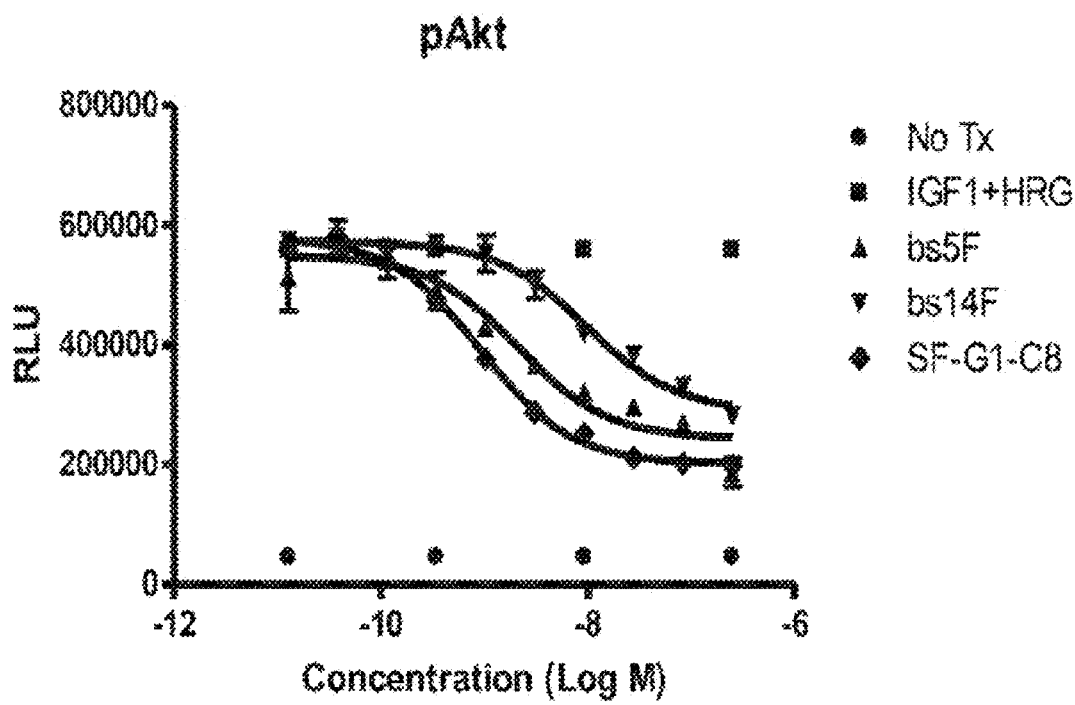
Figure 32I:
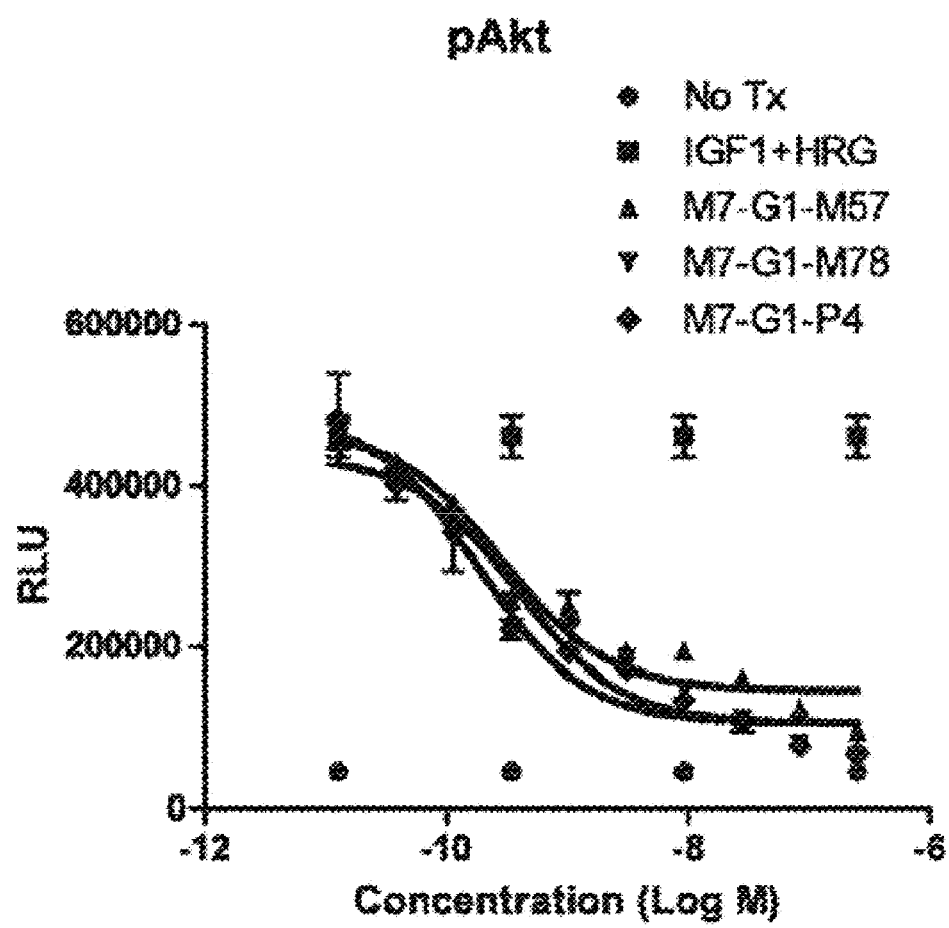
Figure 33A:
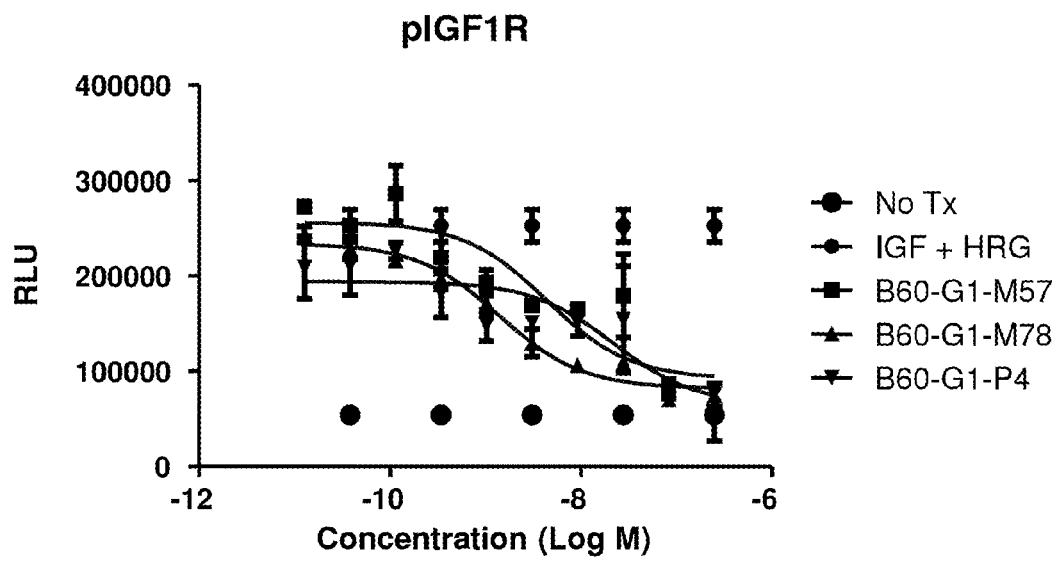
Figure 33B:
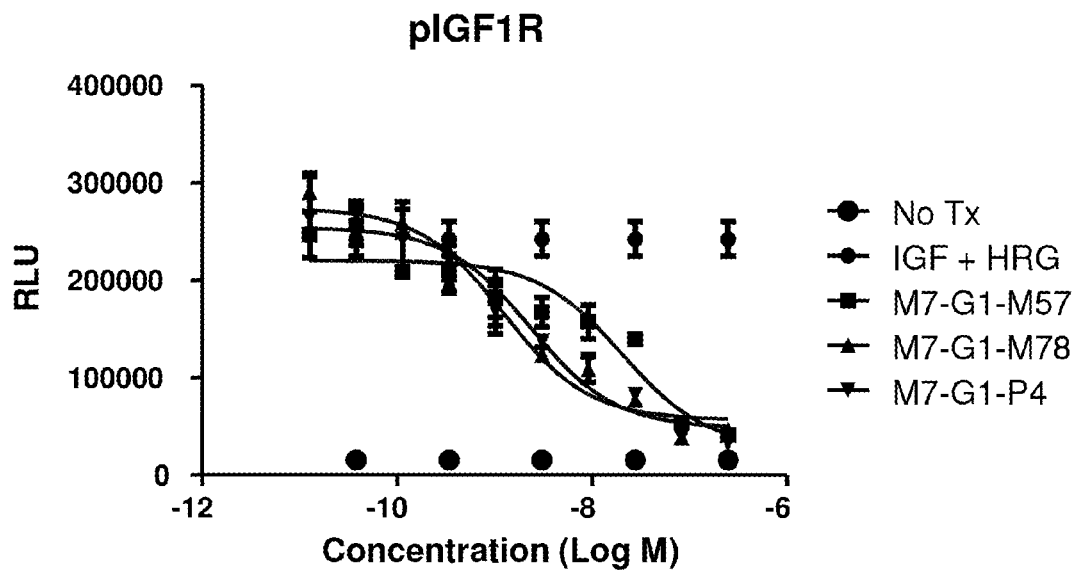
Figure 33C:
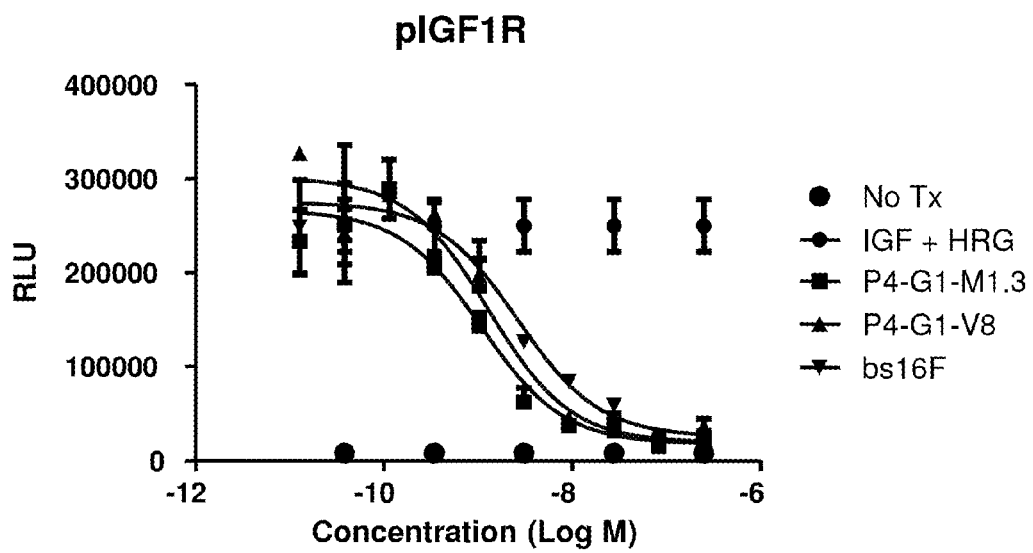
Figure 33D:
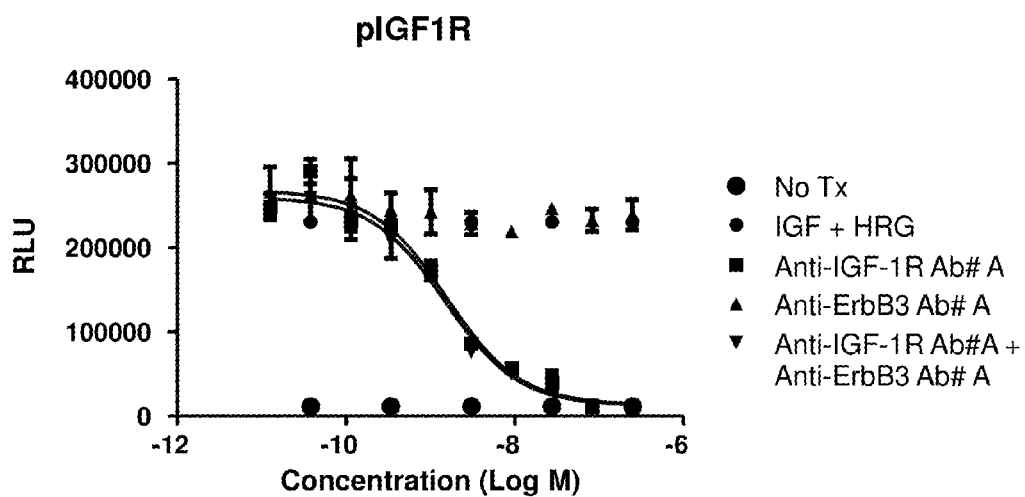
Figure 34A:
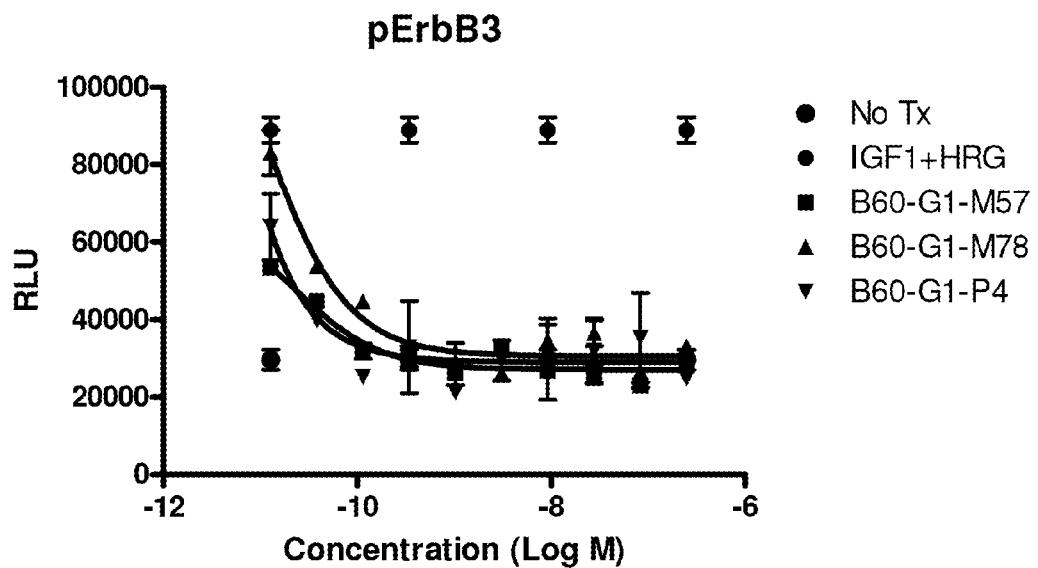
Figure 34B:
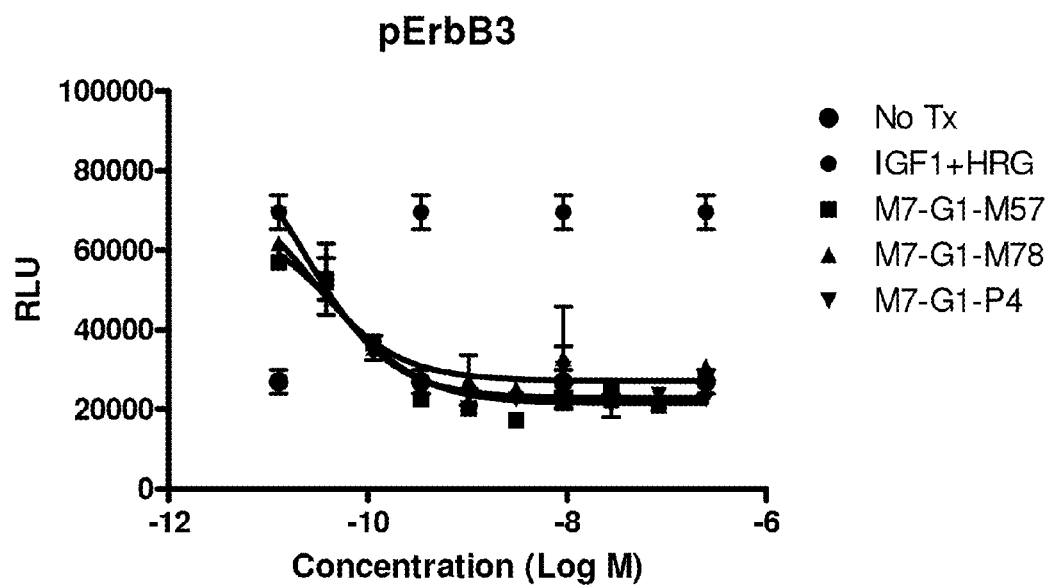
Figure 34C:
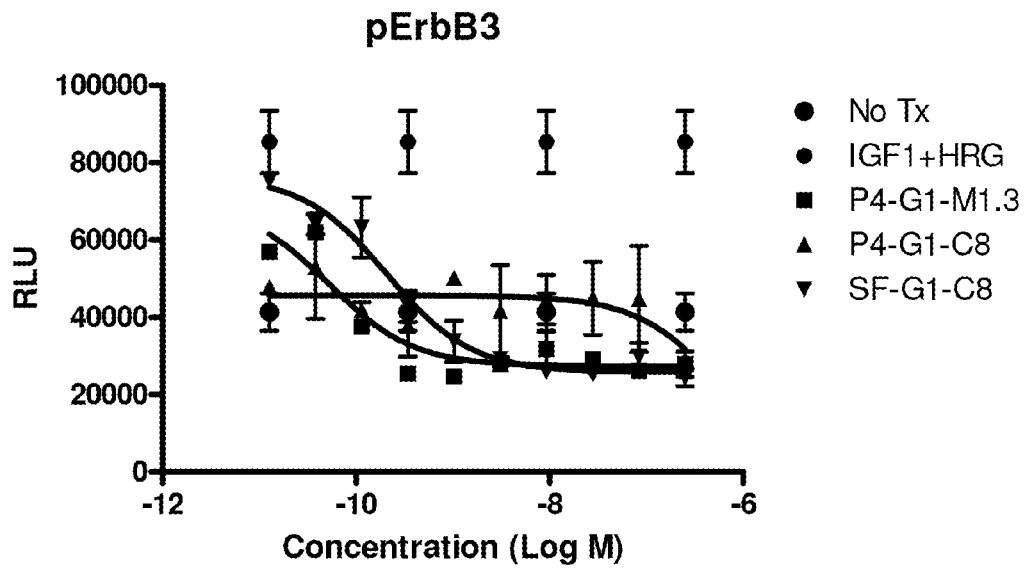
Figure 34D:
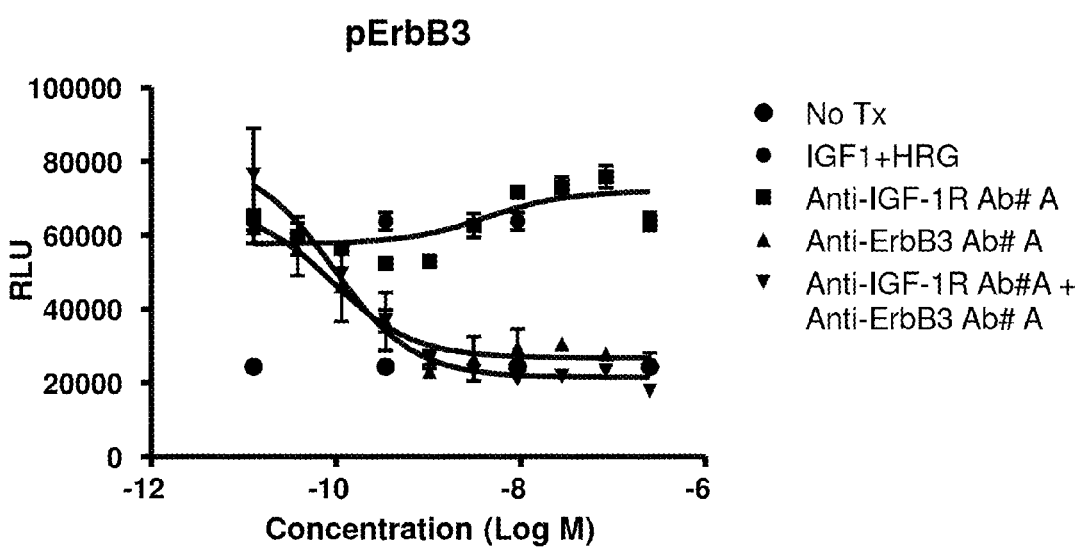
Figure 35A:
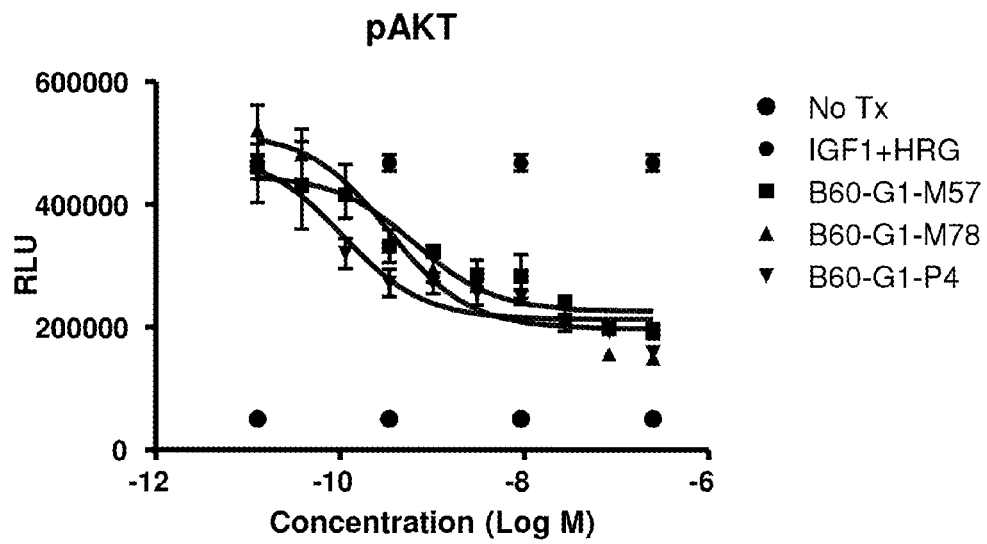
Figure 35B:
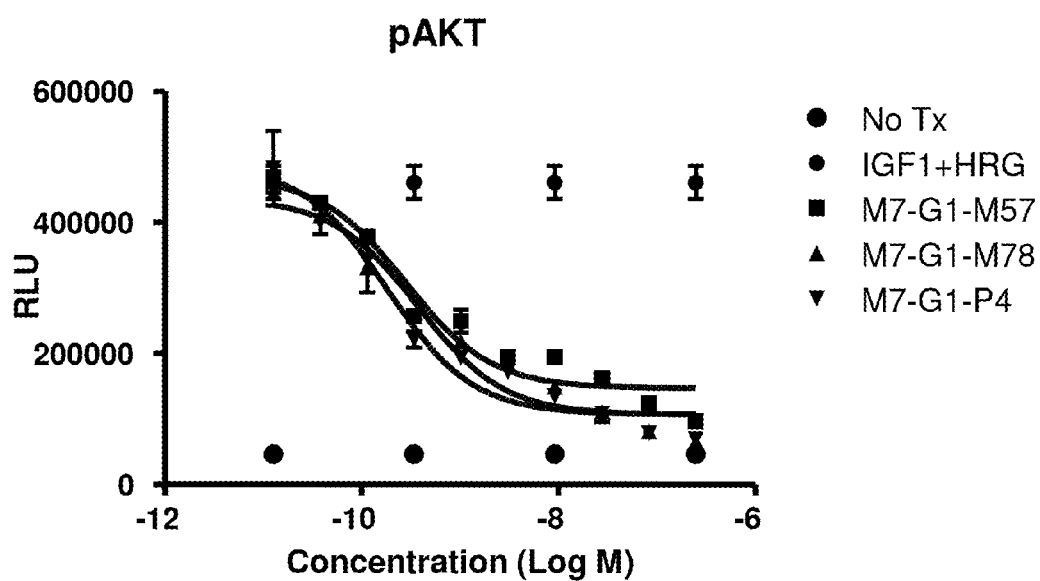
Figure 35C:
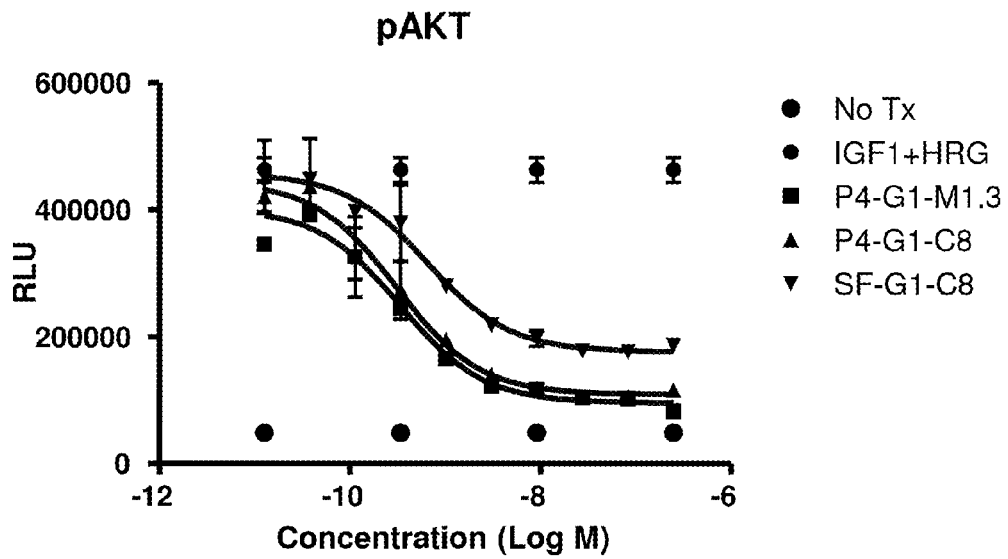
Figure 35D:
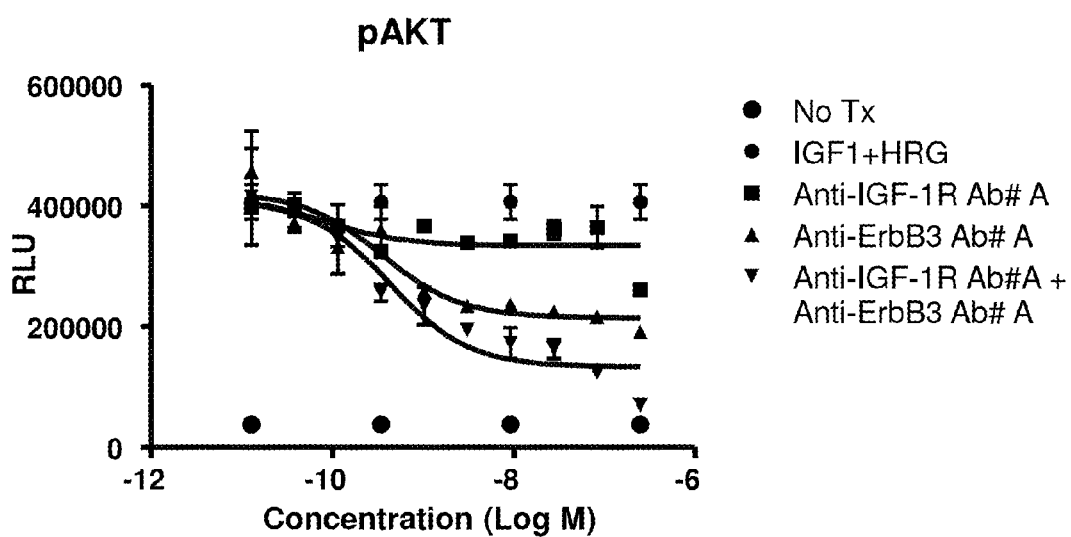

| Bispecific Antibody | EC50 (nM) |
|---|---|
| FIG. 29A | |
| SF-G1-C8 (16F) | 0.6 |
| M27-G1-P4 | 1.2 |
| M27-G1-M57 | 1 |
| M27-G1-M78 | 2.1 |
| B60-G1-P4 | 0.5 |
| B60-G1-M57 | 0.3 |
| B60-G1-M78 | 0.3 |
| M27/M7-G1-P4 | 2.2 |
| M27/M7-G1-M57 | 2 |
| M27/M7-G1-M78 | 1.7 |
| FIG. 29B | |
| SF-G1-C8 (16F) | 0.3 |
| M57-G1-M1.3 | 0.2 |
| M57-G1-P6 | 0.2 |
| M57-G1-V8 | 0.1 |
| M78-G1-M1.3 | 0.2 |
| M78-G1-P6 | 0.4 |
| M78-G1-V8 | 0.3 |
| FIG. 29C | |
| SF-G1-C8 (16F) | 0.3 |
| P4-G1-M1.3 | 0.03 |
| P4-G1-P6 | 0.02 |
| P4-G1-V8 | 0.1 |
| M7-G1-M57 | 0.6 |
| M7-G1-M78 | 1 |
| M7-G1-P4 | 2.8 |
| FIG. 29D | |
| SF-G1-C8 | 1.2 |
| SF-G1-P1 | 2 |
| SF-G1-P6 | 1.1 |
| SF-G1-M27 | 1.5 |
| SF-G1-B69 | 1.1 |
| SF-G1-M1.3 | 1.4 |

B) Inhibition of Cell Signaling

Inhibition of cell signaling by PBAs is determined essentially as follows. BxPC-3 cells are maintained in RPMI-1640 media supplemented with 10% fetal bovine serum, Penicillin/Streptomycin and L-glutamine. $3.5 \times 10^4$ cells are plated in complete medium in 96-well tissue culture plates. The following day, complete medium is replaced with serum-free medium, and cells are incubated overnight at 37° C. Cells are pretreated for 1 hour with the indicated doses of drug, and then stimulated for 15 minutes with 100 ng/ml IGF1 (Calbiochem) and 30 ng/ml HRG (R&D Systems). Cells are washed with PBS and lysed in MPer buffer supplemented with protease and phosphatase inhibitors.

ELISAs for phospho-IGF1R (pIGF1R) phospho-ErbB3 (pErbB3) and phospho-AKT (pAKT) are performed as described in Example 4, above.

ILE-10 (14F or 140) and ELI-7 (5F or 50), both of which are described above, are used as reference proteins.

Results that were obtained essentially as described above and are shown in FIGS. 30 (pIGF-1R), 31 (pErbB3) and 32 (pAKT), and in Table 23 below, indicate that the PBAs display strong inhibition of dual pathway signaling.

TABLE 24

IC50 values for inhibitor treatments presented in FIGS. 33, 34 and 35

| Cell Line | Inhibitor | pIGF1R IC50 | pErbB3 IC50 | pAKT IC50 |
|---|---|---|---|---|
| BxPC-3 | B60-G1-M57 | 4.4E−09 | 2.3E−11 | 6.5E−10 |
| BxPC-3 | B60-G1-M78 | 1.4E−09 | 1.0E−11 | 3.4E−10 |
| BxPC-3 | B60-G1-P4 | 2.2E−08 | ~2.4e−14 | 1.1E−10 |
| BxPC-3 | M7-G1-M57 | 2.1E−08 | 5.2E−11 | 2.8E−10 |
| BxPC-3 | M7-G1-M78 | 1.3E−09 | 2.6E−11 | 3.7E−10 |
| BxPC-3 | M7-G1-P4 | 2.4E−09 | 2.4E−11 | 1.8E−10 |
| BxPC-3 | P4-G1-M1.3 | 1.1E−09 | 5.3E−11 | 3.4E−10 |
| BxPC-3 | P4-G1-C8 | 1.3E−09 | 5.8E−07 | 3.1E−10 |
| BxPC-3 | SF-G1-C8 | 2.6E−09 | 2.1E−10 | 6.5E−10 |
| BxPC-3 | ANTI-IGF-1R Ab# A (ganitumab; SEQ ID 327 + SEQ ID 328) | 1.6E−09 | 4.3E−09 | 8.0E−11 |
| BxPC-3 | anti-ErbB3 Ab# A (SEQ ID 336 + SEQ ID 337) | 2.3E−10 | 9.2E−11 | 3.5E−10 |

TABLE 23

IC50 values and percent inhibition values for inhibitor treatments shown in FIGS. 30, 31 and 32

|  | IC50 pIGF1R | % Inhibition pIGF1R | IC50 pErbB3 | % Inhibition pErbB3 | IC50 pAKT | % Inhibition pAKT |
|---|---|---|---|---|---|---|
| ErbB3 IgG-IGF1R scFv | | | | | | |
| B60-G1-P4 | 4.4E−09 | 88 | 4.0E−11 | 99 | 5.5E−10 | 86 |
| B60-G1-M57 | 1.0E−08 | 85 | 1.2E−09 | 162 | 7.3E−10 | 83 |
| B60-G1-M78 | 3.5E−09 | 86 | 8.0E−11 | 115 | 6.4E−10 | 78 |
| M27-G1-P4 | 3.0E−09 | 88 | 1.0E−10 | 106 | 5.7E−10 | 90 |
| M27-G1-M57 | 8.1E−09 | 83 | 3.1E−10 | 88 | 1.3E−09 | 84 |
| M27-G1-M78 | 1.4E−09 | 87 | 1.2E−10 | 107 | 6.6E−10 | 92 |
| M27/M7-G1-P4 | 1.3E−08 | 99 | 4.0E−11 | 111 | 2.5E−10 | 92 |
| M27/M7-G1-M57 | 7.5E−09 | 91 | 1.5E−10 | 179 | 5.3E−10 | 91 |
| M27/M7-G1-M78 | 1.0E−09 | 91 | 1.1E−10 | 140 | 3.5E−10 | 92 |
| M7-G1-M57 | 2.10E−08 | 82 | 5.2E−11 | 124 | 2.8E−10 | 88 |
| M7-G1-M78 | 1.30E−09 | 88 | 2.6E−11 | 111 | 3.7E−10 | 95 |
| M7-G1-P4 | 2.40E−09 | 93 | 2.4E−11 | 109 | 1.8E−10 | 95 |
| IGF1R IgG - ErbB3 scFv | | | | | | |
| M57-G1-M1.3 | 4.1E−10 | 94 | 1.4E−10 | 99 | 2.3E−09 | 85 |
| M57-G1-P6 | 2.5E−10 | 92 | 7.9E−11 | 98 | 2.1E−09 | 79 |
| M57-G1-C8 | 2.5E−10 | 93 | 6.5E−11 | 98 | 2.0E−09 | 80 |
| M78-G1-M1.3 | 5.0E−10 | 97 | 1.4E−10 | 99 | 2.2E−09 | 92 |
| M78-G1-P6 | 4.2E−10 | 95 | 1.4E−10 | 100 | 2.1E−09 | 86 |
| M78-G1-C8 | 6.8E−10 | 96 | 2.3E−10 | 98 | 4.1E−09 | 84 |
| P4-G1-M1.3 | 1.8E−10 | 92 | 5.5E−11 | 94 | 1.1E−09 | 86 |
| P4-G1-P6 | 1.6E−10 | 91 | 3.9E−11 | 95 | 1.2E−09 | 82 |
| P4-G1-C8 | 1.3E−10 | 91 | 3.6E−11 | 94 | 1.2E−09 | 78 |
| SF-G1-C8 | 5.2E−10 | 91 | 1.9E−10 | 98 | 3.9E−09 | 71 |

In another set of experiments, the level of inhibition of ligand-induced signal transduction by the PBAs was compared to that obtained with prior art anti-IGF-1R (anti-ErbB3 Ab# A—SEQ ID NO:336 for HC and 337 for LC) and prior art anti-ErbB3 (ANTI-IGF-1R Ab# A—SEQ ID NO:327 for the HC and SEQ ID NO:328 for the LC) antibodies. The experiments were conducted essentially as described immediately above in this Example.

The results, (FIGS. 33, 34 and 35 and Table 24), indicate that the PBAs show surprisingly high levels of inhibition of dual pathway signaling relative to the combination of ANTI-IGF-1R Ab# A and anti-ErbB3 Ab# A.

TABLE 24-continued

IC50 values for inhibitor treatments presented in FIGS. 33, 34 and 35

| Cell Line | Inhibitor | pIGF1R IC50 | pErbB3 IC50 | pAKT IC50 |
|---|---|---|---|---|
| BxPC-3 | ANTI-IGF-1R Ab# A + anti-ErbB3 Ab# A | 1.5E−09 | 9.4E−11 | 4.3E−10 |

C) Stability of the Bispecific Proteins

Various stability studies were performed essentially as described in Example 5D above, and their results show that the PBAs tested were stable in serum and were thermally stable.

Serum stability results, (FIG. 36), indicate that the PBAs display some differences in serum stability. The lowest stability was about 65% and the highest stability was about 100%. Those that have a number of about 1 (or above) are considered to have about 100% stability.

Melting temperatures results are of Table 25. The results indicate that the PBAs unfold at varying temperatures.

TABLE 25

$T_m$ values for each bispecific antibody, as determined by DSF. M27/M7 refers to a binding site having an M27 heavy chain and an M7 light chain.

| Bispecific Antibody | Tm (° C.) | Bispecific Antibody | Tm (° C.) |
|---|---|---|---|
| B60-G1-P4 | 66.5 | M57-G1-M1.3 | 64.5 |
| B60-G1-M57 | 67.8 | M57-G1-P6 | 65.5 |
| B60-G1-M78 | 67.5 | M57-G1-C8 | 66.5 |
| M27-G1-P4 | 66.5 | M78-G1-M1.3 | 68.5 |
| M27-G1-M57 | 67.2 | M78-G1-P6 | 66.5 |
| M27-G1-M78 | 66.8 | M78-G1-C8 | — |
| M27/M7-G1-P4 | 66.5 | P4-G1-M1.3 | 62.5 |
| M27/M7-G1-M57 | 68.5 | P4-G1-P6 | 63.5 |
| M27/M7-G1-M78 | 67.5 | P4-G1-C8 | 66.5 |
|  |  | M7-G1-M57 | 70.5 |
|  |  | M7-G1-M78 | 67.5 |
|  |  | M7-G1-P4 | 66.5 |

SEC stability results are shown in Table 26, and indicate that the PBAs are mostly monomeric.

TABLE 26

Percent monomer determined by SEC for each bispecific antibody

| Bispecific Antibody | Percent Monomer | Bispecific Antibody | Percent Monomer |
|---|---|---|---|
| B60-G1-P4 | 91 | M57-G1-M1.3 | 79 |
| B60-G1-M57 | 92 | M57-G1-P6 | 77 |
| B60-G1-M78 | 87 | M57-G1-C8 | 77 |
| M27-G1-P4 | 84 | M78-G1-M1.3 | 79 |
| M27-G1-M57 | 87 | M78-G1-P6 | 80 |
| M27-G1-M78 | 83 | M78-G1-C8 | 77 |
| M27/M7-G1-P4 | 90 | P4-G1-M1.3 | 92 |
| M27/M7-G1-M57 | 93 | P4-G1-P6 | 86 |
| M27/M7-G1-M78 | 78 | P4-G1-C8 | 95 |
| M7-G1-P4 | 82.4 |  |  |
| M7-G1-M57 | 87.4 |  |  |
| M7-G1-M78 | 82 |  |  |

Example 8

Identification of Additional High Affinity Anti-IGF-1R and Anti-ErbB3 Binding Domains Many more high affinity anti-IGF-1R and anti-ErbB3 binding domains were isolated via phage screening. The sequences of the heavy and light chain of these proteins are of FIGS. 1-4 under the 16F sequences. The sequences of anti-IGF-1R binding sites start with "5-7" and the sequences of anti-ErbB3 binding sites start with "E3B."

Example 9

Potent Inhibition of Dual IGF1- and HRG-Stimulated Signaling by Anti-EGF1R-Anti+ErbB3 BPAs This Example shows that anti-EGF1R+anti-ErbB3 PBAs are potent inhibitors of dual IGF1 and HRG-stimulated signal transduction in DU145 and BxPC-3 cells.

Results were obtained essentially as follows. 35,000 BxPC-3 cells are plated in 10% serum overnight at 37° C. The following day, cells are starved in media containing 0.5% serum and incubated overnight at 37° C. Cells were pretreated for one hour with the indicated concentrations of Ab, and then stimulated for 15 minutes with 30 ng/ml HRG1b1-ECD+100 ng/ml IGF1. In this Example, and in Examples 10-13 and 21, control anti-IGF1R and anti-ErbB3 mAb are ANTI-IGF-1R Ab#A and anti-ErbB3 Ab#A, respectively. Cells are lysed in M-Per buffer (+protease/phosphatase inhibitors) and run on ELISA for pAKT. For the pAKT ELISA assay, plates are coated with anti-AKT (Millipore), blocked with PBS+2% BSA, incubated with lysates and standards, and detected with a biotinylated anti-pAKT (Ser473) and streptavidin-HRP. ELISA pico chemiluminescent substrate is added and plates are read on a Perkin-Elmer Envision plate reader. All IC50 curves and calculated values are generated in Graphpad Prism.

The results, (FIG. 39), indicate that PBAs M7-G1-M78, P4-G1-M1.3, P4-G1-C8 and SF-G1-C8 potently inhibit signal transduction induced by IGF-1 and HRG in both DU145 and BxPC-3 cells, as determined by measuring phosphorylated AKT (pAKT).

Example 10

Anti-IGF1R+Anti-ErbB3 BPA Potency is Maintained Over a Broad Range of Receptor Profiles This Example shows that anti-IGF1R+anti-ErbB3 PBAs are potent inhibitors of dual IGF1 and HRG-stimulated signal transduction in cells having various levels of IGF1R or ErbB3.

Results were obtained essentially as follows. BxPC-3 cells are infected with lentivirus expressing a control hairpin, or with shRNA specific to IGF1R or ErbB3 (Sigma) that reduces expression of these proteins by about 50%. Knockdown is confirmed by FACS and Western blot analysis. Cells are plated and treated as described in Example 9. Levels of pAKT are determined as described in Example 9.

The results, (FIG. 40 and Table 27), indicate that PBAs M7-G1-M78, P4-G1-M1.3, P4-G1-C8 and SF-G1-C8 potently inhibit signal transduction induced by IGF-1 and HRG in BxPC-3 cells having high or lower levels (50% reduced levels) of IGF1R or ErbB3, as determined by measuring phosphorylated AKT (pAKT).

TABLE 27

PBAs IC50 (in M) and percent inhibition of results shown in FIG. 40

| Cell Line | Inhibitor | pAKT % Inhibition | pAKT IC50 |
|---|---|---|---|
| BxPC-3 (Vector Control) | M7-M78 | 89.8 | 1.1E−09 |
| BxPC-3 (Vector Control) | P4-M1.3 | 87.9 | 7.1E−10 |
| BxPC-3 (Vector Control) | P4-C8 | 78.3 | 1.4E−09 |

TABLE 27-continued

PBAs IC50 (in M) and percent inhibition of results shown in FIG. 40

| Cell Line | Inhibitor | pAKT % Inhibition | pAKT IC50 |
|---|---|---|---|
| BxPC-3 (Vector Control) | SF-C8 | 68.8 | 3.5E−09 |
| BxPC-3 (Vector Control) | ANTI-IGF-1R Ab# A (Ganitumab; SEQ ID 327 + SEQ ID 328) | 38.2 | 2.1E−08 |
| BxPC-3 (Vector Control) | ANTI-ErbB3 Ab# A (SEQ ID 336 + SEQ ID 337) | 47.2 | 2.5E−09 |
| BxPC-3 (Vector Control) | ANTI-IGF-1R Ab# A + ANTI-ErbB3 Ab# A | 90.6 | 3.3E−09 |
| BxPC-3 (50% IGF1R KD) | M7-M78 | 90.9 | 3.4E−10 |
| BxPC-3 (50% IGF1R KD) | P4-M1.3 | 91.1 | 3.8E−10 |
| BxPC-3 (50% IGF1R KD) | P4-C8 | 80.4 | 7.6E−10 |
| BxPC-3 (50% IGF1R KD) | SF-C8 | 74.5 | 6.3E−09 |
| BxPC-3 (50% IGF1R KD) | ANTI-IGF-1R Ab# A (Ganitumab; SEQ ID 327 + SEQ ID 328) | 51 | 4.0E−08 |
| BxPC-3 (50% IGF1R KD) | ANTI-ErbB3 Ab# A (SEQ ID 336 + SEQ ID 337) | 58.2 | 1.6E−09 |
| BxPC-3 (50% IGF1R KD) | ANTI-IGF-1R Ab# A + ANTI-ErbB3 Ab# A | 89.8 | 1.3E−09 |
| BxPC-3 (50% ErbB3 KD) | M7-M78 | 91.2 | 4.0E−10 |
| BxPC-3 (50% ErbB3 KD) | P4-M1.3 | 90.7 | 3.2E−10 |
| BxPC-3 (50% ErbB3 KD) | P4-C8 | 90.9 | 3.3E−10 |
| BxPC-3 (50% ErbB3 KD) | SF-C8 | 82.7 | 2.1E−09 |
| BxPC-3 (50% ErbB3 KD) | ANTI-IGF-1R Ab# A (Ganitumab; SEQ ID 327 + SEQ ID 328) | 47.7 | 1.3E−07 |
| BxPC-3 (50% ErbB3 KD) | ANTI-ErbB3 Ab# A (SEQ ID 336 + SEQ ID 337) | 59.7 | 2.8E−10 |
| BxPC-3 (50% ErbB3 KD) | ANTI-IGF-1R Ab# A + ANTI-ErbB3 Ab# A | 92.8 | 6.0E−10 |

BPAs are indicated with "G1" in Table 27. For example, "M7-M78" refers to "M7-G1-M78."

Example 11

Anti-IGF1R+Anti-ErbB3 PBAs are Potent Inhibitors of Low Dose or High Dose IGF1- or HRG-Induced Signaling This Example shows that anti-IGF1R+anti-ErbB3 PBAs are potent inhibitors of dual IGF1 and HRG-stimulated signal transduction in response to high or low ligand (IGF1 or HRG) concentration.

The results were obtained essentially as follows. 35,000 BxPC-3 cells are plated in 10% serum overnight at 37° C. The following day, cells are starved in media containing 0.5% serum and incubated overnight at 37° C. Cells are pretreated for one hour with the indicated concentrations of PBA, and then stimulated for 15 minutes with either low (40 ng/ml) or high (400 ng/ml) IGF1, or low (20 ng/ml) or high (200 ng/ml) HRG1b1-ECD. ELISA for pErbB3, pIGF1R, and tIGF1R are from commercial sources (R & D Systems). For the pAKT ELISA assay, plates are coated with anti-AKT (Millipore), blocked with PBS+2% BSA, incubated with lysates and standards, and detected with a biotinylated anti-pAKT (Ser473) and streptavidin-HRP. ELISA pico chemiluminescent substrate is added and plates are read on a Perkin-Elmer Envision plate reader. All IC50 curves and calculated values are generated in Graphpad Prism.

The results, (FIGS. 41, 42 and Table 28), indicate that the PBAs M7-G1-M78, P4-G1-M1.3, P4-G1-C8 and SF-G1-C8 potently inhibit signal transduction induced by higher or lower levels of IGF-1 and HRG in BxPC-3 cells, as determined by measuring pAKT (pAKT), pIGF-1R and pErbB3 levels.

TABLE 28

PBA IC50s (in M) and percent inhibition of results shown in FIGS. 41 and 42

| Ligand | Ligand Conc. | Readout | ANTI-IGF-1R Ab# A (ganitumab; SEQ ID NO: 327 + SEQ ID NO: 328) | M7-G1-M78 | P4-G1-C8 | P4-G1-M1.3 | SF-G1-C8 |
|---|---|---|---|---|---|---|---|
| IGF1 | 40 ng/ml | pIGF1R | 7.80E−10 | 1.00E−09 | 1.10E−10 | 1.20E−10 | 5.10E−10 |
| IGF1 | 400 ng/ml | pIGF1R | 2.50E−10 | 2.40E−09 | 8.80E−11 | 9.90E−11 | 4.40E−10 |
| IGF1 | 40 ng/ml | pAKT | 7.40E−09 | 3.80E−10 | 3.80E−10 | 1.40E−10 | 1.30E−09 |
| IGF1 | 400 ng/ml | pAKT | 9.10E−09 | 6.40E−10 | 3.40E−10 | 2.10E−10 | 5.90E−10 |

| Ligand | Ligand Conc. | Readout | ANTI-ErbB3 Ab# A (SEQ ID NO: 336 + SEQ ID NO: 337) | M7-G1-M78 | P4-G1-C8 | P4-G1-M1.3 | SF-G1-C8 |
|---|---|---|---|---|---|---|---|
| HRG | 20 ng/ml | pErbB3 | 2.41E−10 | 6.16E−11 | 6.76E−11 | 3.12E−11 | 2.69E−10 |
| HRG | 200 ng/ml | pErbB3 | 1.98E−10 | 6.53E−11 | 5.70E−11 | 2.72E−11 | 2.66E−10 |
| HRG | 20 ng/ml | pAKT | 3.06E−10 | 7.12E−11 | 1.06E−10 | 3.97E−11 | 4.32E−10 |
| HRG | 200 ng/ml | pAKT | 3.26E−10 | 6.46E−11 | 1.01E−10 | 4.09E−11 | 5.50E−10 |

Example 12

Anti-IGF1R+Anti-ErbB3 PBAs Suppress Basal Signaling

This Example shows that anti-IGF1R+anti-ErbB3 PBAs inhibit basal levels of signal transduction.

Results were obtained essentially as follows. 35,000 BxPC-3 cells are plated in 10% serum overnight at 37° C. The following day, cells are starved in media containing 0.5% serum and incubated overnight at 37° C. Cells are pretreated for either 15 minutes or 24 hours in the presence of the indicated concentration of Ab, but in the absence of ligand stimulation. Cells are lysed in M-Per buffer (+protease/phosphatase inhibitors) and run on ELISA for pAKT, as described in Example 9.

The results, (FIG. 43), indicate that PBAs M7-G1-M78, P4-G1-M1.3, and P4-G1-C8 suppress the basal level of pAKT.

Example 13

Anti-IGF1R+Anti-ErbB3 PBAs Potently Downregulate IGF1R

This Example shows that anti-IGF1R+anti-ErbB3 PBAs downregulate IGF1R.

Results were obtained essentially as follows. 35,000 BxPC-3 cells are plated in 10% serum overnight at 37° C. The following day, cells are starved in media containing 0.5% serum and incubated overnight at 37° C. Cells are then incubated for 24 hours in media containing 0.5% serum and the indicated concentrations of antibody (starting at a high dose of 5E-07M with subsequent 3-fold dilutions). Cells are lysed and total IGF1R is measured by ELISA using a commercial kit from R&D Systems. Percent downregulation is calculated from Prism using the following formula: 100*((fit.max-min.observed)/(fit.max-no stimulation).

The results, (FIG. 44 and Table 29), indicate that PBAs M7-G1-M78, P4-G1-M1.3, and P4-G1-C8 reduce the level of IGF1R in A549 and BxPC-3 cells.

TABLE 29

Potent Downregulation of IGF1R by PBAs.

| Cell Line | Molecule | % IGF1R Downregulation |
|---|---|---|
| A549 | M7-G1-M78 | 48 |
| A549 | P4-G1-C8 | 70 |
| A549 | P4-G1-M1.3 | 72 |
| A549 | ANTI-IGF-1R Ab# A (Ganitumab; SEQ ID 327 + SEQ ID 328) | 57 |
| BxPC-3 | M7-G1-M78 | 53 |
| BxPC-3 | P4-G1-C8 | 67 |
| BxPC-3 | P4-G1-M1.3 | 71 |
| BxPC-3 | ANTI-IGF-1R Ab# A (Ganitumab; SEQ ID 327 + SEQ ID 328) | 51 |

Example 14

Anti-IGF1R+Anti-ErbB3 BPAs Inhibit Both IGF1 and IGF2 Mediated Signaling

This example shows that anti-IGF1R+anti-ErbB3 BPAs inhibit signaling induced by IGF1 and IGF2.

The results were obtained essentially as follows. 500,000 DU145 and Mia PaCa-2 cells per well are plated in 12-well plates overnight in 10% serum. On day 2 cells are serum starved overnight. On day 3 antibody pre-incubations are performed for 1 hr (250 nM P4-G1-M1.3 or P4-G1-C8) and growth factors (IGF1 or IGF2 at 100 ng/ml) are added for 15 minutes prior to lysis. All cells are washed with PBS and lysed in 100 ul of MPer buffer supplemented with protease and phosphatase inhibitors. Prior to running the samples on 4-12% Bis-Tris gels, loading buffer containing b-Mercaptoethanol (b-ME) is added and lysates are boiled for 5 minutes at 95° C. Gels are run at 150 volts constant for approximately 90 minutes and transferred to nitrocellulose membranes using the iBlot (Invitrogen) transfer system's 8 minute transfer program. Membranes are blocked in Odyssey Blocking Buffer (Licor Biosciences) for 1 hour at room temperature, and then incubated with primary antibodies overnight at 4 degrees C. in 5% BSA in TBS-T. Antibodies used are pAkt, pIGF1R, Beta Actin (all from Cell Signaling Technologies). B-Actin was used at 1:5,000, Phospho-Akt at 1:2,000, and all others at 1:1,000. The following day membranes are washed 3×5 minutes each with TBS-T and then incubated with anti-Rabbit IgG-DyLight800 (Cell Signaling) at 1:15,000 in 5% milk in TBS-T for 1 hour at room temperature. Membranes are then washed 3×5 minutes each with TBS-T and scanned using the Licor Odyssey system (Licor Biosciences). Integrated intensities are calculated and normalized to Beta-Actin levels.

The results, (FIG. 45), show that BPAs P4-G1-M1.3 and P4-G1-C8 inhibit AKT phosphorylation induced by either IGF1 or IGF2.

Example 15

Anti-IGF1R+Anti-ErbB3 BPAs Partially Inhibit Insulin Signaling

This example shows that anti-IGF1R+anti-ErbB3 BPAs partially inhibit insulin signaling in DU145 cells.

The results were obtained essentially as follows. 500,000 DU145 cells per well are plated in 12-well plates overnight in 10% serum. On day 2 cells are serum starved overnight. On day 3 Ab pre-incubations are performed for 1 hr (500 nM P4-G1-M1.3) and growth factors (IGF1 at 100 ng/ml or Insulin at 5 ug/ml) are added for 15 minutes prior to lysis. Lysates and Western blots are prepared as described in Example 14.

The results, (FIG. 46), indicate that BPA P4-G1-M1.3 partially inhibits signal transduction induced by insulin, as measured by pAKT levels.

Example 16

Anti-IGF1R+Anti-ErbB3 BPAs Downregulate Total Receptor Levels of ErbB3 and IGF1R This Example shows that anti-IGF1R+anti-ErbB3 BPAs downregulate ErbB3 and IGF1R levels on cells that are either induced by IGF1 and HRG or not induced.

The results were obtained essentially as follows. 500,000 BxPC-3 cells per well are plated in 12-well plates overnight in 10% serum. On day 2 cells are serum starved overnight. On day 3 antibody pre-incubations are performed for 6 hr (250 nM M7-G1-M78 or P4-G1-C8). To half of the samples growth factors (IGF1 at 100 ng/ml and HRG at 30 ng/ml) are also added for 15 minutes prior to lysis. Lysates and Western blots are prepared as described in Example 14. IGF1R, ErbB3 and pErbB3 are also from Cell Signaling Technologies.

The results, (FIG. 47), indicate that total levels (phosphorylated and non-phosphorylated) of ErbB3 and IGF1R are reduced by BPAs M7-G1-M78 and P4-G1-C8.

Example 17

Anti-IGF1R+Anti-ErbB3 BPAs Display Stability in Human, Mouse and Monkey Serum This Example shows that anti-IGF1R+anti-ErbB3 BPAs are stable in human, mouse and monkey serum.

The results were obtained essentially as follows. PBAs are incubated in either pooled human serum (Innovative Research), mouse serum (Sigma) or Cynomolgous monkey serum (Innovative Research) at a final concentration of 2.5 uM for either 0 days or 5 days at 37° C. The samples are then assayed using a colorimetric ELISA binding assay. 96-well Reacti-bind plates (Pierce, Fisher cat. No. PI-15041) are coated with 50 ul of the protein corresponding to the antibody's scFv (either ErbB3-His or IGF1R-His (R&D Systems, cat. No. 348-RB and 305-GR, respectively) at 2 ug/ml in PBS) and incubated overnight at 4° C. The next day plates are washed with PBS+0.05% Tween-20 (PBS-T) and blocked for 1 hr. at room temperature with 100 ul of Protein-Free Blocking Buffer (Pierce). Plates are washed with PBS-T and 50 ul of each BPA is added in duplicate. Concentrations start at 500 nM (1:5 dilution of 2.5 uM bsAb in serum) in PBS-T and include ten additional two-fold dilutions (in PBS-T+20% serum) and one blank (PBS-T+Serum only). Plates are incubated at room temperature for two hours and then washed with PBS-T. 50 ul of anti-Fc-HRP (Jackson Labs) is added at 1:40,000 in PBS-T, and plates are incubated in the dark for 1 hr. at room temperature. Plates are again washed with PBS-T and 100 ul of TMB substrate (Thermo Scientific, TMB and peroxide solution mixed 1:1) is added. The plates are incubated for 5-15 minutes at room temperature until a blue color develops, and the reaction is stopped with 100 ul of STOP solution (Cell Signaling Technology). The absorbance is read at 450 nm on a PerkinElmer Envision plate reader, and binding curves are generated with GraphPad Prism.

The results, (FIG. 48), show that BPAs M7-G1-M78, P4-G1-M1.3, and P4-G1-C8 are stable for at least 5 days in mouse and cyno serum and that P4-G1-M1.3 is stable for at least 6 days in human serum.

Example 18

Anti-IGF1R+Anti-ErbB3 BPAs Display Cross-reactivity with Human, Mouse, Rat And Monkey IGF1R and ErbB3

This example shows that anti-IGF1R+anti-ErbB3 BPAs are cross-reactive with human, mouse, rat and monkey IGF1R and ErbB3.

Results were obtained essentially as follows. 96-well Reacti-bind® plates (Pierce, Fisher cat. No. PI-15041) are coated with 50 ul of species specific ErbB3-His or IGF-1R-His (R&D Systems, cat. No. 348-RB and 305-GR, respectively) at 2 ug/ml in PBS and incubated overnight at 4° C. The next day plates are washed with PBS+0.05% Tween-20 (PBS-T) and blocked for 1 hr. at room temperature with 100 ul of Protein-Free Blocking Buffer (Pierce). Plates are washed with PBS-T and 50 ul of each PBA is added in duplicate. Concentrations start at 500 nM (in PBS-T) and included ten additional two-fold dilutions and one blank (PBS-T only). Plates are incubated at room temperature for two hours and then washed with PBS-T. 50 ul of anti-Fc-HRP (Jackson Labs) is added at 1:40,000 in PBS-T, and plates are incubated in the dark for 1 hr. at room temperature. Plates are again washed with PBS-T and 100 ul of TMB substrate (Thermo Scientific, TMB and peroxide solution mixed 1:1) is added. The plates are incubated for 5-15 minutes at room temperature until a blue color develops, and the reaction is stopped with 100 ul of STOP solution (Cell Signaling Technology). The absorbance is read at 450 nm on a PerkinElmer Envision plate reader, and binding curves are generated using GraphPad Prism.

The results, (FIG. 49), show that the BPAs P4-G1-C8, P4-G1-M1.3 and M7-G1-M78 bind efficiently to human, mouse, rat and monkey IGF1R and ErbB3.

Example 19

Anti-IGF1R+Anti-ErbB3 BPAs Block IGF1 and IGF2 Binding to Their Receptor IGF1R

This Example shows that anti-IGF1R+anti-ErbB3 BPAs block the binding of both IGF1 and IGF2 to IGF1R.

The results were obtained essentially as follows. ELISA plates are coated with IGF1R-His and blocked as described in Example 18. Following the blocking step, plates are washed and incubated with IGF1 (100 ng/ml) or IGF2 (100 ng/ml) (EMD Chemicals) for 1 hour at room temperature. Plates are washed with PBS-T, and 100 ul of each Ab is added in duplicate. Concentrations start at 500 nM (in PBS-T) and include ten additional two-fold dilutions and one blank (PBS-T only). Plates are incubated at room temperature for 1 hour and then washed with PBS-T. 50 ul of Rabbit anti-Human IGF1 (Thermo Scientific) or Rabbit anti-Human IGF2 (Abeam) are added at 1:1,000 in PBS-T for 1 hr. at room temperature. Plates are again washed and incubated in Anti-Rabbit HRP (Cell Signaling) at 1:1,000 in PBS-T for 1 hour at room temperature. Plates are developed, read and analyzed as described above.

The results, (FIG. 50), indicate that P4-G1-M1.3 inhibited the binding of both IGF1 and IGF2 binding to IGF1R.

Example 20

Anti-IGF1R+Anti-ErbB3 BPAs Display Dose-dependent and Different Half Lives in Mice and Long Half Lives in Cynomolgus Monkeys This Example provides pharmacokinetic properties of anti-IGF1R+anti-ErbB3 BPAs in mice and Cynomolgus monkeys.

The results were obtained essentially as follows. Dosing and collection of samples: Mice are dosed by IV bolus with P4-G1-M1.3 or M7-G1-M78 at either 100 ug/mouse or 500 ug/mouse and bleeds are taken at 0.25, 1, 4, 8, 24, 48, 72, 96 and 168 hours. Four mice are bled per timepoint. IV infusion of Cynomolgus Monkeys (WIL Research Laboratories) is performed with P4-C8 and P4-M1.3. Two monkeys in each group are dosed at either 5 mg/kg or 25 mg/kg and bled at 0.08, 1, 4, 8, 24, 48, 72, 96 and 168 hours. ELISA binding assay and modeling analysis: Reacti-bind® 96-well plates (Pierce, Fisher cat. No. PI-15041) are coated with 50 ul of IGF1R (No Tag) at 2 ug/ml in PBS and incubated overnight at 4° C. Plates are washed with PBS-0.05% Tween-20 (PBS-T) and blocked for 1 hr at room temperature with 100 ul of Pierce Protein-Free Blocking Buffer. Plates are again washed with PBS-T. 100 ul of samples and standards are added to plates and incubate for 2 hrs at room temperature. For standard curves the antibodies are diluted to 12 ug/ml in PBS-T, then 10 additional 3-fold dilutions with the final well blank. Serum samples are diluted at 1:50 in PBS-T with 10 additional 3-fold dilutions and a final well blank. Plates are washed with PBS-T and 100 ul of ErbB3-His added at 1 ug/ml in PBS-T for 1 hr at room temperature. Plates are washed and 100 ul anti-His-HRP (Abcam) is added at 1:10,000 in PBS-T and incubated (covered) for 1 hr. at room temperature. Plates are again washed with PBS-T and 100 ul of TMB substrate (Thermo Scientific, TMB and peroxide solution mixed 1:1) was added. The plates are incubated for 5-15 minutes at room temperature until a blue color develops, and the reaction is stopped with 100 ul of STOP solution (Cell Signaling Technology). The absorbance is read at 450 nm on a PerkinElmer Envision plate reader, and the data analysis is performed using MAT- LAB (Mathworks—www.mathworks.com) and WinNonLin (Pharsight—www.pharsight.com) according to standard protocols.

The results in mice, (Table 30), indicate that the BPAs M7-G1-M78 and P4-G1-M1.3 have a half life in mice that ranges from 3.33 to 41.90 hours on average, depending on the BPA and on the concentration of BPA administered to the mouse. The results in Cynomolgus monkey, (Table 31), indicate that the half live of P4-G1-C8 and P4-G1-M1.3 is 51 and 61 hours, respectively, for 5 mg/kg, and 115 and 78 hours, respectively, for 25 mg/kg of PBA. Thus, PBAs having the orientation anti-IGF1R-anti-ErbB3 (i.e., in which the anti-IGF1R portion is a full length Ab and the anti-ErbB3 portion is made up of two scFvs) are more stable than a PBA having the opposite conformation (i.e., in which the anti-ErbB3 is a full length Ab and the anti-IGF1R portion is made up of two scFvs).

TABLE 30

Half-life (in hours) of BPAs in mice

| Molecule | Dose (ug/mouse) | Mean | 95% Conf Interval | |
|---|---|---|---|---|
| M7-G1-M78 | 100 | 3.33 | 2.43 | 5.32 |
|  | 500 | 11.16 | 9.40 | 13.75 |
| P4-G1-M1.3 | 100 | 10.91 | 8.24 | 16.11 |
|  | 500 | 41.90 | 28.79 | 76.98 |

TABLE 31

Half-life (in hours) of BPAs in Cynomolgus monkeys

| Molecule | Dose (mg/kg) | MATLAB Terminal T½ (hrs) | 95% CI | WinNonLin Terminal T/12 (hrs) | Rsq |
|---|---|---|---|---|---|
| P4-C8 | 5 | 51 | 39-73 | 46.8529 | 0.9998 |
|  | 25 | 115 | 83-189 | 93.5036 | 0.959 |
| P4-M1.3 | 5 | 61 | 39-140 | 62.1732 | 0.9901 |
|  | 25 | 78 | 57-123 | 80.8655 | 0.9934 |

Example 21

P4-G1-M1.3 Displays in Vitro Inhibition of Ligand-Induced Receptor Activation and Akt/mTOR/ERK Signaling Over Time This Example shows that P4-G1-M1.3 inhibits ligand-induced phosphorylation of IGF-1R and ErbB3 as well as the downstream proteins Akt, Erk, mTOR and S6 in BxPC-3 cultured cells over time.

Methods

BxPC-3 cells are maintained in RPMI-1640 media supplemented with 10% fetal bovine serum, Penicillin/Streptomycin and L-glutamine. $3.5 \times 10^4$ cells are plated in complete medium in 96-well tissue culture plates. The following day, complete medium is replaced with serum-free medium, and cells are incubated overnight at 37° C. Cells are either pretreated for 1 hour with 1 µM of P4-G1-M1.3 or kept in serum-free medium without inhibitor, and then all cells are stimulated for 5, 15, 30, 60 or 120 minutes with 100 ng/ml IGF1 (Calbiochem) and 70 ng/ml HRG (R&D Systems). Cells are washed with PBS and lysed in MPer buffer supplemented with protease and phosphatase inhibitors.

ELISAs for phospho-IGF1R (pIGF1R) phospho-ErbB3 (pErbB3) and phospho-AKT (pAKT) are performed as described in Example 4, above. ELISAs for phospho-ERK (pERK, Cell Signaling Technology catalog #7246), phospho-S6 (pS6, R&D Systems catalog #DYC3918) and phospho-mTOR (pmTOR, R&D Systems catalog #DYC1665) are performed according the manufacturer's instructions. Resulting concentrations of each phosphorylated protein are normalized to levels of total protein, determined using the BCA method.

The results, (FIG. 51), indicate that P4-G1-M1.3 is able to significantly block ligand-induced production of Phospho-IGF-1R (51A), Phospho-ErbB3 (51B), Phospho-Akt (51C), Phospho-ERK (p44/p42; 51D), Phospho-mTOR (Ser2448, 51E), and Phospho-S6 (Ser235/236; 51F) in the presence of IGF-1 and HRG.

Example 22

Anti-IGF1R+Anti-ErbB3 PBAs Block Signaling Mediated by IGF1R-insulin Receptor Heterodimers This Example shows that the inhibition of insulin and IGF2 signaling by anti-IGF1R+anti-ErbB3 PBAs is mediated by IGF1R-insulin receptor heterodimers.

The results were obtained essentially as follows. 500,000 BxPC-3 and A673 cells per well are plated in 12-well plates overnight in 10% serum. On day 2 cells are serum starved overnight. On day 3 antibody pre-incubations are performed for 1 hr (500 nM P4-G1-M1.3) and growth factors (IGF1, IGF2 at 100 ng/ml or Insulin at 5 ug/ml) are added for 15 minutes prior to lysis.

The results, (FIG. 52), indicate that P4-G1-M1.3 is able to significantly block IGF2 and insulin signaling in A673 cells, which express high levels of Insulin Receptor (IR). This level of inhibition was not seen in BxPC-3 cells which express low IR levels.

Example 23

PBA P4-G1-M13 Displays Superior Reductions of mTOR Activation and mTOR Protein Levels Relative to an Anti-IGF-1R mAb This Example shows that P4-G1-M1.3 displays superior control of mTOR activation relative to an anti-IGF-1R mAb in end-of-study BxPC-3 tumors.

The profiling of tumors from a BxPC-3 xenograft study was conducted essentially as follows. Mice with human tumor cell line xenografts were prepared and various treatments administered essentially as described above in Example 3D. Five end-of-study tumors were harvested from the PBS control group, the highest dose group of P4-G1-M1.3 (500 ug/mouse q3d), and the highest dose group of anti-IGF1R Ab# A (ganitumab; SEQ ID NO:327+SEQ ID NO:328) (368 ug/mouse q3d), and prepared essentially as follows. Lysates are generated by tissue pulverization and lysis in TER1 buffer (Invitrogen). Total protein is quantified by the BCA method, and equivalent total protein is run on 4-12% SDS-PAGE gels. Gels are transferred to nitrocellulose using standard methods. Western blotting is performed using: anti-mTOR and anti-phospho-mTOR (Ser2448) primary antibodies (all from Cell Signaling Technology). Secondary antibody used is anti-Rabbit IgG—DyeLight800 (Cell Signaling Technology). Blots are developed using the Li-Cor Odyssey system. Normalization to β-Actin is performed by dividing the intensity of the target band by its associated β-Actin control band.

The results, (FIGS. 53A and B and Table 32), indicate that mTOR and phospho-mTOR(Ser2448) levels are significantly lower in tumors from mice treated with the PBA P4-G1-M1.3, relative to mice treated with the anti-IGF-1R Ab# A.

TABLE 32

P4-G1-M1.3 displays superior control of mTOR activity, relative to anti-IGF-1R Ab# A in end-of-study BxPC-3 tumors

| Samples | Levels of mTOR relative to buffer control | Levels of phospho-mTOR relative to buffer control |
|---|---|---|
| Buffer control | 1.0 | 1.0 |
| P4-G1-M1.3 | 2.4 | 1.1 |
| ANTI-IGF-1R Ab# A (ganitumab; SEQ ID NO: 327 + SEQ ID NO: 328) | 10.5 | 2.3 |

Example 24

P4-G1-M1.3 Downregulates Receptors and Inhibits PI3K/Akt/mTOR Signaling in Caki-1 and BxPC-3 Xenograft Models This Example shows that P4-G1-M1.3 downregulates receptors and inhibits PI3K/Akt/mTOR signaling in Caki-1 human renal clear cell carcinoma and BxPC-3 human pancreatic adenocarcinoma xenograft models in end-of-study tumors.

The profiling of tumors from a Caki-1 xenograftstudy was conducted essentially as follows. Mice with human tumor cell line xenografts were prepared and various treatments administered essentially as described above in Example 3D. For the Caki-1 xenograft study, 3 groups were established, each containing 5 mice. These included control, P4-G1-M1.3 (600 μg), and anti-IGF-1R Ab# A (291 μg dose 1, 320 μg dose 2). Antibodies were dosed twice, IP, at a three day interval. Everolimus was dosed PO, qd. Tumors were harvested 24 hours after the second antibody dose.

The profiling of tumors from a BxPC-3 xenograftstudy was conducted essentially as described in Example 23.

Tumors were initially weighed and pulverized in a Cryo-Prep tissue pulverizer (Model CP-02, Covaris). Tissue Extraction Reagent 1 (TER1, Life Technologies™) containing protease and phosphatase inhibitors was added to the tumor at a ratio of 1 ml TER1 per 100 mg of tissue. Samples were incubated on ice for 30 minutes to solubilize tissue and put through a QIAshredder™ column (Qiagen) according to the manufacturers protocol. A BCA assay (Pierce) was performed to determine protein concentration according to the manufacturer's protocol.

Samples were analyzed by western blot. Loading buffer containing β-Mercaptoethanol (β-ME) was added and lysates were boiled for 5 minutes at 95° C. Approximately 40 μg of protein and two ladders (Invitrogen) were run on each well of an 18-well gel (BioRad). Gels were run at 150 volts constant for approximately 90 minutes and transferred to nitrocellulose membranes using the iBlot® (Invitrogen) transfer system's 8 minute transfer program. Membranes were blocked in Odyssey® Blocking Buffer (Licor® Biosciences) for 1 hour at room temperature, and then incubated with primary antibodies overnight at 4° C. in 5% BSA in TBS-T. All antibodies were purchased from Cell Signaling and used at the recommended dilution. The following day membranes were washed 3×5 minutes each with TBS-T and then incubated with anti-Rabbit IgG-DyLight® 800 (Cell Signaling) or anti-Rabbit IRDye® 800 (Licor® Biosciences) at 1:10,000-15,000 in 5% milk in TBS-T for 1 hour at room temperature. Membranes were then washed 3×5 minutes each with TBS-T and scanned using the Licor® Odyssey® system (Licor® Biosciences). Band intensities were quantified using Image Studio 2.0 and normalized to β-Actin levels. In Caki-1 xenografts control tumors were compared to those treated with P4-G1-M1.3, Anti-IGF-1R Ab#A+Anti-ErbB3 Ab# A, or everolimus.

The results of the Caki-1 profiling study, (FIGS. 54 A-F), indicate that levels of IGF-1R, insulin receptor, ErbB3, EGFR, pAKT(Ser473 or Thr308), pFox01 (Thr24)/Fox03a (Thr32) and phospho-mTOR(Ser2448 or Ser2481) are all similar to levels in control mice or lower in tumors from mice treated with P4-G1-M1.3, relative to mice treated with the Anti-IGF-1R Ab# A+Anti-ErbB3 Ab# A combination or the mTOR inhibitor everolimus.

The results of the BxPC-3 profiling study, (FIGS. 55 A-C), indicate that IGF-1R, ErbB3, pEGFR, pmTOR (S2448), and pS6 (S235/236) are all lower in tumors from mice treated with P4-G1-M1.3, relative to mice treated with the Anti-IGF-1R Ab#A or PBS alone.

Example 25

P4-G1-M1.3 Blocks IGF-1 and IGF-2 Binding to Receptors

This Example shows by means of an ELISA assay that P4-G1-M1.3 effectively blocks the binding of IGF-1 and IGF-2 to IGF-1R.

96-well Reacti-bind® plates (Pierce) were coated with 50 μl of IGF-1R-His (R&D Systems cat. No. 305-GR; 2 μg/ml in PBS) and incubated overnight at 4° C. The next day plates were washed with PBS+0.05% Tween-20 (PBS-T) and blocked for 1 hr. at room temperature with 100 μl of Protein-Free Blocking Buffer (Pierce). Plates were washed with PBS-T and 100.4 of P4-G1-M1.3 was added in duplicate. Antibody concentration started at 500 nM (in PBS-T) and included ten additional two-fold dilutions and one blank (PBS-T only). Plates were incubated at room temperature for two hours and then washed with PBS-T. 100 μl of either IGF-1 or IGF-2 (EMD Chemicals) was added at 100 ng/ml and incubated at room temperature for one hour. Following washing, 100 μl of either Rabbit-Anti-IGF-1 or Rabbit-Anti-IGF-2 (both Abcam, 5 μg/ml) were added to the plates and incubated for one hour at room temperature. Plates were then washed and incubated with 100 μl of Anti-Rabbit-HRP (Cell Signaling) for 1 hour at room temperature, washed again and 100 μl of TMB substrate (Cell Signaling) was added. The plates were incubated for 5-15 minutes at room temperature until a blue color developed, and the reaction was stopped with 100 μl of STOP solution (Cell Signaling Technology). The absorbance was read at 450 nm on a PerkinElmer Envision plate reader, and binding curves were generated using GraphPad Prism®.

The results of the ELISA assay, (FIG. 56), show that P4-G1-M1.3 blocks both IGF-1 and IGF-2 binding to IGF-1R in a dose-dependent manner.

Example 26

P4-G1-M1.3 and P4-G1-C8 in DU145, BxPC-3, SK-ES-1, and Caki-1 Tumor Xenograft Models For each of studies A-D below, cells were respsusended 1:1 with PBS:Growth factor-reduced Matrigel® and injected subcutaneously into Nu/Nu mice. Tumors were allowed to develop for 8 days. Antibodies were injected intraperitoneally every 3 days (q3d) at the indicated doses/mouse. Tumor lengths and widths were measured twice a week manually by caliper, and tumor volume calculated using the following formula: $\pi/6(L \times W^2)$. Each arm of the study contained 10 animals.

A. P4-G1-C8 and P4-G1-M1.3 Suppress Tumor Growth of DU145 Prostate Cancer Cells in Vivo.

For this DU145 xenograft study, $8 \times 10^6$ DU145 cells were prepared and used as described above.

The results (FIG. 57A), show that both P4-G1-C8 and P4-G1-M.3 suppress the growth of prostate cancer cells in vivo.

B. P4-G1-C8 and P4-G1-M1.3 Suppress Tumor Growth of BxPC-3 Pancreatic Cancer Cells in Vivo Better than an Anti-IGF-1R IgG.

For thisaft study, $5 \times 10^6$ BxPC-3 cells were prepared and used as described above.

The results (FIG. 57B), show that P4-G1-C8 and P4-G1-M1.3 suppress tumor growth of BxPC-3 pancreatic cancer cells in vivo and that both are superior to anti-IGF-1R Ab# A in inhibiting tumor cell growth.

C. P4-G1-M1.3 Suppresses Tumor Growth of SK-ES-1 Ewing's Sarcoma Cancer Cells in Vivo For this xenograft study, $10 \times 10^6$ SK-ES-1 cells were prepared and used as described above.

The results (FIG. 57C), show that P4-G1-M1.3 suppresses tumor cell growth in a dose-dependent manner.

D. P4-G1-M1.3 Suppresses Tumor Growth of Caki-1 Renal Cell Carcinoma Cancer Cells in Vivo and Displays Superior Suppression Compared to the Combination of an Anti-IGF-1R IgG and an anti-ErbB3 IgG.

For this study, $8 \times 10^6$ Caki-1 cells were prepared and used as described above.

The results (FIG. 57D), show that P4-G1-M1.3 suppresses tumor cell growth in a dose-dependent manner and is more effective at inhibiting tumor cell growth that a combination of anti-IGF-1R Ab# A (ganitumab; SEQ ID NO:327+SEQ ID NO:328) and anti-ErbB3 Ab# A (SEQ ID NO:336+SEQ ID NO:337) antibody, whether these antibodies are given at an equal exposure or at equimolar dosing.

Example 27

Computational Analysis of PK Data to Design PD/Efficacy Studies in Mice

This Example describes the computational methodology used to fit mathematical modeling to experimental data to estimate the pharmacokinetics (PK) parameters of M1.3-G1-P4.

Fitting Mathematical Modeling to PK Data

The PK parameters of M1.3-G1-P4 were inferred via implementation of the intravenous (IV) bolus target mediated drug disposition (TMDD) model. The IV TMDD is a 2-compartment PK model structured as a set of 4 coupled differential equations, as follows:

$$\frac{d[Dc]}{dt} = -C_{ld}[Dc] + C_{ld}[Dp]\frac{Vp}{Vc} - C_l[Dc] - k_{on}[R][Dc] + k_{off}[D:R] \quad (1A)$$

$$\frac{d[Dp]}{dt} = C_{ld}[Dc]\frac{Vc}{Vp} - C_{ld}[Dp] \quad (1B)$$

$$\frac{d[R]}{dt} = k_{in} - k_{out}[R] - k_{on}[R][Dc] + k_{off}[D:R] \quad (1C)$$

$$\frac{d[D:R]}{dt} = k_{on}[R][Dc] - k_{off}[D:R] - k_{el}[D:R] \quad (1D)$$

In equations 1A-1D, Dc and Dp are the concentrations of the drug in the central and peripheral compartments, Vc and Vp are the volumes of the central and peripheral compartments, whereas R and D:R denote the concentrations of the free target receptor and drug-receptor complex in the central compartment. Moreover, $C_{ld}$, $C_l$, $k_{in}$, $k_{out}$, $k_{on}$, $k_{off}$ and $k_{el}$ respectively represent the rate constants of transport across compartments, drug clearance from the central compartment, receptor synthesis, receptor degradation, drug-receptor association, drug-receptor dissociation, and drug-receptor clearance from the central compartment. The IV TMDD model describes the dynamics processes of drug binding to the target receptor and drug clearance in the central compartment as well as the process of drug transport from the central to the peripheral compartment when the drug of interest is directly injected in the central compartment (blood). Fitting TMDD model to experimental data obtained from mice blood enables estimating the PK properties of M1.3-G1-P4.

FIG. 58 shows the fitting of TMDD model to experimental data (solid line=fit of 500 μg/mouse dose given i.v., dotted line=fit of 100 μg/mouse dose given i.v.). The M1.3-G1-P4 PK parameters are listed in Table 24 below.

TABLE 24

PK parameters of M1.3-G1-P4 inferred from fitting of IV TMDD modeling to PK data obtained from mice blood

| | $C_{ld}$ (h$^{-1}$) | $C_l$ (h$^{-1}$) | $k_{in}$ (ng mL$^{-1}$ h$^{-1}$) | $k_{out}$ (h$^{-1}$) | $k_{on}$ (ng$^{-1}$ h$^{-1}$) | $k_{off}$ (h$^{-1}$) | $k_{el}$ (h$^{-1}$) | Vc mL | Vt mL |
|---|---|---|---|---|---|---|---|---|---|
| M1.3-G1-P4 | 0.203 | 0.030 | 1020.44 | 0.0415 | 0.006 | 0.01 | 0.0001 | 1.386 | 51.745 |

Equivalents

Those skilled in the art will recognize, or be able to ascertain and implement using no more than routine experimentation, many equivalents of the specific embodiments described herein. Such equivalents are intended to be encompassed by the following claims. Any combinations of the embodiments disclosed in the dependent claims are contemplated to be within the scope of the disclosure.

Incorporation By Reference

The disclosure of each and every U.S. and foreign patent and pending patent application and publication referred to herein is specifically incorporated by reference herein in its entirety.

SEQUENCE LISTING (429 sequences)

SEQ ID NO: 1 - protein, 122 aa, Artificial Sequence
  Description of Artificial Sequence: Synthetic consensus sequence
  MOD_RES (28)..(28): Phe, Asp, Asn, Thr, Leu, Val, Met, Glu, Arg, Ser, Ala, Trp or Pro
  MOD_RES (31)..(31): Lys, Ser, Arg, Val, His, Glu, Ile, Asn, Asp, Ala or Thr
  MOD_RES (49)..(49): Ser or Gly
  MOD_RES (53)..(53): Ser, Gly, Ala or Pro
  MOD_RES (54)..(54): Asp, Ser, Trp, Gly or Leu
  MOD_RES (59)..(59): Val, Pro, Arg, Ile or Ala
  MOD_RES (88)..(88): Ala or Pro
  MOD_RES (102)..(102): Thr, Gln, Asp, Tyr, Asn, Arg, Trp, Phe, His, Met or Lys
  MOD_RES (103)..(103): Trp, Ile, Met or Leu
  MOD_RES (111)..(111): Ser, Met, Tyr, Ile, Lys, Glu, Val, Ala, Arg, Thr or Asn
  MOD_RES (117)..(117): Ser or Thr
  see specification as filed for detailed description of substitutions and preferred embodiments
EVQLLQSGGGLVQPGGSLRLSCAASGFXFSXYPMHWVRQAPGKGLEWVXSISXXGGATXYADSVKGRFTISRDNSKNTLYLQMNSLRXEDTAVYYCAKDFYXXLTGNAFDXWGQGTXVTVSS

SEQ ID NO: 2 - protein, 107 aa, Artificial Sequence
  Description of Artificial Sequence: Synthetic consensus sequence
  MOD_RES (4)..(4): Leu or Met
  MOD_RES (15)..(15): Leu or Thr
  MOD_RES (51)..(51): Arg, Ser, Lys, Ala, Gly, Gln, Thr, Asn, Pro or Asp
  MOD_RES (54)..(54): Arg, Leu, Cys, Thr, Pro, Gly, Ser, Lys, Glu, Gln, His Ala, Tyr, Ile
  MOD_RES (70)..(70): Glu or Asp
  MOD_RES (83)..(83): Ser or Phe
  MOD_RES (84)..(84): Ala or Gly
  MOD_RES (92)..(92): Trp or Phe
  MOD_RES (93)..(93): Thr, Ala, Arg, Met, Phe, Ser, Asn, Trp, Gln, Leu or Val
  MOD_RES (94)..(94): Trp or Phe
  see specification as filed for detailed description of substitutions and preferred embodiments
DIQXTQSPSSLSASXGDRVTITCRASQGISSYLAWYQQKPGKAPKLLIYAXSTXQSGVPSRFSGSGSGTXFTLTISSLQPEDXXTYYCQQYXXXPLTFGGGTKVEIK

SEQ ID NO: 3 - protein, 107 aa, Artificial Sequence
  Description of Artificial Sequence: Synthetic consensus sequence
  MOD_RES (4)..(4): Leu or Met
  MOD_RES (51)..(51): Arg, Ser, Lys, Ala, Gly, Gln, Thr, Asn, Pro or Asp
  MOD_RES (54)..(54): Arg, Leu, Cys, Thr, Pro, Gly, Ser, Lys, Glu, Gln, His Ala, Tyr, Ile
  MOD_RES (70)..(70): Glu or Asp
  MOD_RES (84)..(84): Ala or gly
  MOD_RES (93)..(93): Thr, Ala, Arg, Met, Phe, Ser, Asn, Trp, Gln, Leu or Val
  MOD_RES (94)..(94): Trp or Phe
  see specification as filed for detailed description of substitutions and preferred embodiments
DIQXTQSPSSLSASLGDRVTITCRASQGISSYLAWYQQKPGKAPKLLIYAXSTXQSGVPSRFSGSGSGTXFTLTISSLQPEDSXTYYCQQYWXXPLTFGGGTKVEIK

SEQ ID NO: 4 - protein, 122 aa, Artificial Sequence
  Description of Artificial Sequence: Synthetic consensus sequence
  MOD_RES (1)..(1): Glu or Gln
  MOD_RES (6)..(6): Glu or Gln
  MOD_RES (16)..(16): Arg or Gly
  MOD_RES (49)..(49): Ser or Ala
  MOD_RES (54)..(54): Asp or Asn
  MOD_RES (58)..(58): Val, Arg, Thr, Ile, Met, Ser, Asn or Leu
  MOD_RES (88)..(88): Ala or Pro
  MOD_RES (93)..(93): Leu or Val
  MOD_RES (102)..(102): Ala, Phe or Tyr
  MOD_RES (103)..(103): Tyr, Asn, Lys, Phe, Met or Ser
  MOD_RES (106)..(106): Glu, Val, Trp, Leu, Gln or Asn
  MOD_RES (107)..(107): Glu or Asp
  see specification as filed for detailed description of substitutions and preferred embodiments
XVQLVXSGGGLVQPGXSLRLSCAASGFTFDDYAMHWVRQAPGKGLEWVXGISWXSGSXGYADSVKGRFTISRDNAKNSLYLQMNSLRXEDTAXYYCARDLGXXQWXXGFDYWGQGTLVTVSS

SEQ ID NO: 5 - protein, 122 aa, Artificial Sequence
  Description of Artificial Sequence: Synthetic consensus sequence
  MOD_RES (1)..(1): Glu or Gln
  MOD_RES (6)..(6): Glu or Gln
  MOD_RES (16)..(16): Arg or Gly
  MOD_RES (49)..(49): Ser or Ala
  MOD_RES (54)..(54): Asp or Asn
  MOD_RES (58)..(58): Val, Arg, Thr, Ile, Met, Ser, Asn or Leu
  MOD_RES (102)..(102): Ala, Phe or Tyr
  MOD_RES (103)..(103): Tyr, Asn, Lys, Phe, Met or Ser
  MOD_RES (106)..(106): Glu, Val, Trp, Leu, Gln or Asn
  MOD_RES (107)..(107): Glu or Asp
  see specification as filed for detailed description of substitutions and preferred embodiments
XVQLVXSGGGLVQPGXSLRLSCAASGFTFDDYAMHWVRQAPGKGLEWVXGISWXSGSXGYADSVKGRFTISRDNAKNSLYLQMNSLRAEDTALYYCARDLGXXQWXXGFDYWGQGTLVTVSS

SEQ ID NO: 6 - protein, 109 aa, Artificial Sequence
  Description of Artificial Sequence: Synthetic consensus sequence
  MOD_RES (2)..(2): Ser or Tyr
  MOD_RES (65)..(65): Ser or Thr
  MOD_RES (69)..(69): Ser or Thr
  MOD_RES (88)..(88): Asn, Glu or Met
  MOD_RES (92)..(92): Trp, Val, Thr, Ser, His, Tyr, Asn or Ala
  MOD_RES (93)..(93): Ser or Pro
  MOD_RES (95)..(95): Asn or Asp
  MOD_RES (96)..(96): Gln, Lys, His, Ser, Val, Arg, Thr or Asn
  MOD_RES (108)..(108): Leu or Ile
  see specification as filed for detailed description of substitutions and preferred embodiments
SXELTQDPAVSVALGQTVRITCQGDSLRSYYASWYQQKPGQAPVLVIYGKNNRPSGIPDRFSGSXSGNXASLTITGAQAEDEADYYCXSRDXXGXXWVFGGGTKVTVXG

SEQ ID NO: 7 - protein, 109 aa, Artificial Sequence
  Description of Artificial Sequence: Synthetic consensus sequence
  MOD_RES (2)..(2): Ser or Tyr
  MOD_RES (65)..(65): Ser or Thr
  MOD_RES (69)..(69): Ser or Thr
  MOD_RES (88)..(88): Asn, Glu or Met
  MOD_RES (92)..(92): Trp, Val, Thr, Ser, His, Tyr, Asn or Ala
  MOD_RES (95)..(95): Asn or Asp
  MOD_RES (96)..(96): Gln, Lys, His, Ser, Val, Arg, Thr or Asn
  MOD_RES (108)..(108): Leu or Ile
  see specification as filed for detailed description of substitutions and preferred embodiments
SXELTQDPAVSVALGQTVRITCQGDSLRSYYASWYQQKPGQAPVLVIYGKNNRPSGIPDRFSGSXSGNXASLTITGAQAEDEADYYCXSRDXPGXXWVFGGGTKVTVXG

SEQ ID NO: 8 - protein, 122 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSS

SEQ ID NO: 9 - protein, 122 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSS

SEQ ID NO: 10 - protein, 122 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSS

SEQ ID NO: 11 - protein, 122 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSS

SEQ ID NO: 12 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRPEDTAVYYCAKDFYDMLTGNAFDKWGQGTSVTVSS

SEQ ID NO: 13 - protein, 122 aa, Artificial Sequence
  Description of Artificial Sequence: Synthetic polypeptide
EVQLLQSGGGLVQPGGSLRLSCAASGFLFSRYPMHWVRQAPGKGLEWVSSISSSGGATPYADSVKGRFTISRDNSKNTLYLQMNSLRPEDTAVYYCAKDFYTMLTGNAFDEWGQGTTVTVSS

SEQ ID NO: 14 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRAEDTAVYYCAKDFYYMLTGNAFDVWGQGTTVTVSS

SEQ ID NO: 15 - protein, 122 aa, Artificial Sequence
  Description of Artificial Sequence: Synthetic polypeptide
EVQLLQSGGGLVQPGGSLRLSCAASGFVFSSYPMHWVRQAPGKGLEWVGSISSWGGATPYADSVKGRFTISRDNSKNTLYLQMNSLRPEDTAVYYCAKDFYTLLTGNAFDMWGQGTTVTVSS

SEQ ID NO: 16 - protein, 122 aa, Artificial Sequence; identical to SEQ ID NO: 10
  Description of Artificial Sequence: Synthetic polypeptide

SEQ ID NO: 17 - protein, 122 aa, Artificial Sequence
  Description of Artificial Sequence: Synthetic polypeptide
EVQLLQSGGGLVQPGGSLRLSCAASGFEFSEYPMHWVRQAPGKGLEWVGSISSGGGATPYADSVKGRFTISRDNSKNTLYLQMNSLRAEDTAVYYCAKDFYNILTGNAFDAWGQGTTVTVSS

SEQ ID NO: 18 - protein, 122 aa, Artificial Sequence
  Description of Artificial Sequence: Synthetic polypeptide
EVQLLQSGGGLVQPGGSLRLSCAASGFRFSIYPMHWVRQAPGKGLEWVSSISSSGGATAYADSVKGRFTISRDNSKNTLYLQMNSLRAEDTAVYYCAKDFYRMLTGNAFDRWGQGTSVTVSS

SEQ ID NO: 19 - protein, 122 aa, Artificial Sequence
  Description of Artificial Sequence: Synthetic polypeptide
EVQLLQSGGGLVQPGGSLRLSCAASGFSFSNYPMHWVRQAPGKGLEWVGSISGSGGATPYADSVKGRFTISRDNSKNTLYLQMNSLRAEDTAVYYCAKDFYWMLTGNAFDTWGQGTTVTVSS

SEQ ID NO: 20 - protein, 122 aa, Artificial Sequence
  Description of Artificial Sequence: Synthetic polypeptide
EVQLLQSGGGLVQPGGSLRLSCAASGFAFSSYPMHWVRQAPGKGLEWVGSISASGGATPYADSVKGRFTISRDNSKNTLYLQMNSLRAEDTAVYYCAKDFYQILTGNAFDYWGQGTSVTVSS

SEQ ID NO: 21 - protein, 122 aa, Artificial Sequence; identical to SEQ ID NO: 8
  Description of Artificial Sequence: Synthetic polypeptide

SEQ ID NO: 22 - protein, 122 aa, Artificial Sequence
  Description of Artificial Sequence: Synthetic polypeptide
EVQLLQSGGGLVQPGGSLRLSCAASGFAFSRYPMHWVRQAPGKGLEWVGSISGWGGATPYADSVKGRFTISRDNSKNTLYLQMNSLRPEDTAVYYCAKDFYFMLTGNAFDEWGQGTSVTVSS

SEQ ID NO: 23 - protein, 122 aa, Artificial Sequence
  Description of Artificial Sequence: Synthetic polypeptide
EVQLLQSGGGLVQPGGSLRLSCAASGFLFSSYPMHWVRQAPGKGLEWVGSISSLGGATPYADSVKGRFTISRDNSKNTLYLQMNSLRAEDTAVYYCAKDFYTWLTGNAFDMWGQGTSVTVSS

SEQ ID NO: 24 - protein, 122 aa, Artificial Sequence
  Description of Artificial Sequence: Synthetic polypeptide
EVQLLQSGGGLVQPGGSLRLSCAASGFAFSSYPMHWVRQAPGKGLEWVGSISGSGGATPYADSVKGRFTISRDNSKNTLYLQMNSLRPEDTAVYYCAKDFYHILTGNAFDNWGQGTTVTVSS

SEQ ID NO: 25 - protein, 122 aa, Artificial Sequence
  Description of Artificial Sequence: Synthetic polypeptide
EVQLLQSGGGLVQPGGSLRLSCAASGFWFSDYPMHWVRQAPGKGLEWVGSISSSGGATPYADSVKGRFTISRDNSKNTLYLQMNSLRPEDTAVYYCAKDFYNILTGNAFDRWGQGTSVTVSS

SEQ ID NO: 26 - protein, 122 aa, Artificial Sequence; identical to SEQ ID NO: 9
  Description of Artificial Sequence: Synthetic polypeptide

SEQ ID NO: 27 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRAEDTAVYYCAKDFYMILTGNAFDTWGQGTTVTVSS

SEQ ID NO: 28 - protein, 122 aa, Artificial Sequence
  Description of Artificial Sequence: Synthetic polypeptide
EVQLLQSGGGLVQPGGSLRLSCAASGFPFSAYPMHWVRQAPGKGLEWVSSISASGGATPYADSVKGRFTISRDNSKNTLYLQMNSLRAEDTAVYYCAKDFYKILTGNAFDMWGQGTSVTVSS

SEQ ID NO: 29 - protein, 122 aa, Artificial Sequence
  Description of Artificial Sequence: Synthetic polypeptide
EVQLLQSGGGLVQPGGSLRLSCAASGFPFSTYPMHWVRQAPGKGLEWVGSISSSGGATPYADSVKGRFTISRDNSKNTLYLQMNSLRAEDTAVYYCAKDFYWMLTGNAFDVWGQGTSVTVSS

SEQ ID NO: 30 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRPEDTAVYYCAKDFYWMLTGNAFDKWGQGTTVTVSS

SEQ ID NO: 31 - protein, 122 aa, Artificial Sequence
  Description of Artificial Sequence: Synthetic polypeptide
EVQLLQSGGGLVQPGGSLRLSCAASGFLFSSYPMHWVRQAPGKGLEWVGSISPSGGATPYADSVKGRFTISRDNSKNTLYLQMNSLRPEDTAVYYCAKDFYNILTGNAFDKWGQGTSVTVSS

SEQ ID NO: 32 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIK

SEQ ID NO: 33 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIK

SEQ ID NO: 34 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIK

SEQ ID NO: 35 - protein, 107 aa, Artificial Sequence
  Description of Artificial Sequence: Synthetic polypeptide
DIQMTQSPSSLSASTGDRVTITCRASQGISSYLAWYQQKPGKAPKLLIYAASTLQSGVPSRFSGSGSGTDFTLTISSLQPEDFATYYCQQYFTFPLTFGGGTKVEIK

SEQ ID NO: 36 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTCQSGVPSRFSGSGSGTDFTLTISSLQPEDSGTYYCQQYWTWPLTFGGGTKVEIK

SEQ ID NO: 37 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAKSTRQSGVPSRFSGSGSGTDFTLTISSLQPEDSGTYYCQQYWRWPLTFGGGTKVEIK

SEQ ID NO: 38 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTRQSGVPSRFSGSGSGTEFTLTISSLQPEDSATYYCQQYWMWPLTFGGGTKVEIK

SEQ ID NO: 39 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTTQSGVPSRFSGSGSGTEFTLTISSLQPEDSATYYCQQYWTFPLTFGGGTKVEIK

SEQ ID NO: 40 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAGSTPQSGVPSRFSGSGSGTEFTLTISSLQPEDSGTYYCQQYWFFPLTFGGGTKVEIK

SEQ ID NO: 41 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAKSTRQSGVPSRFSGSGSGTDFTLTISSLQPEDSGTYYCQQYWMFPLTFGGGTKVEIK

SEQ ID NO: 42 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTGQSGVPSRFSGSGSGTDFTLTISSLQPEDSATYYCQQYWRFPLTFGGGTKVEIK

SEQ ID NO: 43 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTPQSGVPSRFSGSGSGTEFTLTISSLQPEDSGTYYCQQYWSFPLTFGGGTKVEIK

SEQ ID NO: 44 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTPQSGVPSRFSGSGSGTDFTLTISSLQPEDSGTYYCQQYWTWPLTFGGGTKVEIK

SEQ ID NO: 45 - protein, 107 aa, Artificial Sequence; identical to SEQ ID NO: 44
  Description of Artificial Sequence: Synthetic polypeptide

SEQ ID NO: 46 - protein, 107 aa, Artificial Sequence; identical to SEQ ID NO: 44
  Description of Artificial Sequence: Synthetic polypeptide

SEQ ID NO: 47 - protein, 107 aa, Artificial Sequence; identical to SEQ ID NO: 43
  Description of Artificial Sequence: Synthetic polypeptide

SEQ ID NO: 48 - protein, 107 aa, Artificial Sequence; identical to SEQ ID NO: 39
  Description of Artificial Sequence: Synthetic polypeptide

SEQ ID NO: 49 - protein, 107 aa, Artificial Sequence; identical to SEQ ID NO: 39
  Description of Artificial Sequence: Synthetic polypeptide

SEQ ID NO: 50 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTLQSGVPSRFSGSGSGTEFTLTISSLQPEDSATYYCQQYWMFPLTFGGGTKVEIK

SEQ ID NO: 51 - protein, 107 aa, Artificial Sequence; identical to SEQ ID NO: 50
  Description of Artificial Sequence: Synthetic polypeptide

SEQ ID NO: 52 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTPQSGVPSRFSGSGSGTEFTLTISSLQPEDSATYYCQQYWNFPLTFGGGTKVEIK

SEQ ID NO: 53 - protein, 107 aa, Artificial Sequence; identical to SEQ ID NO: 52
  Description of Artificial Sequence: Synthetic polypeptide

SEQ ID NO: 54 - protein, 107 aa, Artificial Sequence; identical to SEQ ID NO: 52
  Description of Artificial Sequence: Synthetic polypeptide

SEQ ID NO: 55 - protein, 107 aa, Artificial Sequence; identical to SEQ ID NO: 52
  Description of Artificial Sequence: Synthetic polypeptide

SEQ ID NO: 56 - protein, 107 aa, Artificial Sequence; identical to SEQ ID NO: 52
  Description of Artificial Sequence: Synthetic polypeptide

SEQ ID NO: 57 - protein, 107 aa, Artificial Sequence; identical to SEQ ID NO: 52
  Description of Artificial Sequence: Synthetic polypeptide

SEQ ID NO: 58 - protein, 107 aa, Artificial Sequence; identical to SEQ ID NO: 52
  Description of Artificial Sequence: Synthetic polypeptide

SEQ ID NO: 59 - protein, 107 aa, Artificial Sequence; identical to SEQ ID NO: 52
  Description of Artificial Sequence: Synthetic polypeptide

SEQ ID NO: 60 - protein, 107 aa, Artificial Sequence; identical to SEQ ID NO: 52
  Description of Artificial Sequence: Synthetic polypeptide

SEQ ID NO: 61 - protein, 107 aa, Artificial Sequence; identical to SEQ ID NO: 52
  Description of Artificial Sequence: Synthetic polypeptide

SEQ ID NO: 62 - protein, 107 aa, Artificial Sequence; identical to SEQ ID NO: 52
  Description of Artificial Sequence: Synthetic polypeptide

SEQ ID NO: 63 - protein, 107 aa, Artificial Sequence; identical to SEQ ID NO: 52
  Description of Artificial Sequence: Synthetic polypeptide

SEQ ID NO: 64 - protein, 107 aa, Artificial Sequence; identical to SEQ ID NO: 52
  Description of Artificial Sequence: Synthetic polypeptide

SEQ ID NO: 65 - protein, 107 aa, Artificial Sequence; identical to SEQ ID NO: 52
  Description of Artificial Sequence: Synthetic polypeptide

SEQ ID NO: 66 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTTQSGVPSRFSGSGSGTDFTLTISSLQPEDSGTYYCQQYWTFPLTFGGGTKVEIK

SEQ ID NO: 67 - protein, 107 aa, Artificial Sequence; identical to SEQ ID NO: 66
  Description of Artificial Sequence: Synthetic polypeptide

SEQ ID NO: 68 - protein, 107 aa, Artificial Sequence; identical to SEQ ID NO: 44
  Description of Artificial Sequence: Synthetic polypeptide

SEQ ID NO: 69 - protein, 107 aa, Artificial Sequence; identical to SEQ ID NO: 39
  Description of Artificial Sequence: Synthetic polypeptide

SEQ ID NO: 70 - protein, 107 aa, Artificial Sequence; identical to SEQ ID NO: 39
  Description of Artificial Sequence: Synthetic polypeptide

SEQ ID NO: 71 - protein, 107 aa, Artificial Sequence; identical to SEQ ID NO: 44
  Description of Artificial Sequence: Synthetic polypeptide

SEQ ID NO: 72 - protein, 107 aa, Artificial Sequence; identical to SEQ ID NO: 44
  Description of Artificial Sequence: Synthetic polypeptide

SEQ ID NO: 73 - protein, 107 aa, Artificial Sequence; identical to SEQ ID NO: 32
  Description of Artificial Sequence: Synthetic polypeptide

SEQ ID NO: 74 - protein, 107 aa, Artificial Sequence; identical to SEQ ID NO: 39
  Description of Artificial Sequence: Synthetic polypeptide

SEQ ID NO: 75 - protein, 107 aa, Artificial Sequence; identical to SEQ ID NO: 39
  Description of Artificial Sequence: Synthetic polypeptide

SEQ ID NO: 76 - protein, 107 aa, Artificial Sequence; identical to SEQ ID NO: 44
  Description of Artificial Sequence: Synthetic polypeptide

SEQ ID NO: 77 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTSQSGVPSRFSGSGSGTDFTLTISSLQPEDSGTYYCQQYWWWPLTFGGGTKVEIK

SEQ ID NO: 78 - protein, 107 aa, Artificial Sequence; identical to SEQ ID NO: 39
  Description of Artificial Sequence: Synthetic polypeptide

SEQ ID NO: 79 - protein, 107 aa, Artificial Sequence; identical to SEQ ID NO: 44
  Description of Artificial Sequence: Synthetic polypeptide

SEQ ID NO: 80 - protein, 107 aa, Artificial Sequence; identical to SEQ ID NO: 43
  Description of Artificial Sequence: Synthetic polypeptide

SEQ ID NO: 81 - protein, 107 aa, Artificial Sequence; identical to SEQ ID NO: 34
  Description of Artificial Sequence: Synthetic polypeptide

SEQ ID NO: 82 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTPQSGVPSRFSGSGSGTEFTLTISSLQPEDSATYYCQQYWWWPLTFGGGTKVEIK

SEQ ID NO: 83 - protein, 107 aa, Artificial Sequence; identical to SEQ ID NO: 77
  Description of Artificial Sequence: Synthetic polypeptide

SEQ ID NO: 84 - protein, 107 aa, Artificial Sequence; identical to SEQ ID NO: 77
  Description of Artificial Sequence: Synthetic polypeptide

SEQ ID NO: 85 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTLQSGVPSRFSGSGSGTEFTLTISSLQPEDSATYYCQQYWMFPLTFGGGTKVEIK

SEQ ID NO: 86 - protein, 107 aa, Artificial Sequence; identical to SEQ ID NO: 77
  Description of Artificial Sequence: Synthetic polypeptide

SEQ ID NO: 87 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAQSTKQSGVPSRFSGSGSGTEFTLTISSLQPEDSGTYYCQQYWTWPLTFGGGTKVEIK

SEQ ID NO: 88 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTEQSGVPSRFSGSGSGTEFTLTISSLQPEDSGTYYCQQYWSFPLTFGGGTKVEIK

SEQ ID NO: 89 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWRWPLTFGGGTKVEIK

SEQ ID NO: 90 - protein, 107 aa, Artificial Sequence; identical to SEQ ID NO: 34
  Description of Artificial Sequence: Synthetic polypeptide

SEQ ID NO: 91 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTQQSGVPSRFSGSGSGTEFTLTISSLQPEDSGTYYCQQYWSWPLTFGGGTKVEIK

SEQ ID NO: 92 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTPQSGVPSRFSGSGSGTDFTLTISSLQPEDSATYYCQQYWRFPLTFGGGTKVEIK

SEQ ID NO: 93 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTLQSGVPSRFSGSGSGTEFTLTISSLQPEDSATYYCQQYWTFPLTFGGGTKVEIK

SEQ ID NO: 94 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTSQSGVPSRFSGSGSGTEFTLTISSLQPEDSGTYYCQQYWTWPLTFGGGTKVEIK

SEQ ID NO: 95 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTLQSGVPSRFSGSGSGTDFTLTISSLQPEDSATYYCQQYWSWPLTFGGGTKVEIK

SEQ ID NO: 96 - protein, 107 aa, Artificial Sequence
  Description of Artificial Sequence: Synthetic polypeptide
DIQLTQSPSSLSASLGDRVTITCRASQGISSYLAWYQQKPGKAPKLLIYATSTLQSGVPSRFSGSGSGTEFTLTISSLQPEDSGTYYCQQYWRFPLTFGGGTKVEIK

SEQ ID NO: 97 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWTFPLTFGGGTKVEIK

SEQ ID NO: 98 - protein, 107 aa, Artificial Sequence; identical to SEQ ID NO: 93
  Description of Artificial Sequence: Synthetic polypeptide

SEQ ID NO: 99 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTHQSGVPSRFSGSGSGTDFTLTISSLQPEDSATYYCQQYWRWPLTFGGGTKVEIK

SEQ ID NO: 100 - protein, 107 aa, Artificial Sequence; identical to SEQ ID NO: 82
  Description of Artificial Sequence: Synthetic polypeptide

SEQ ID NO: 101 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTRQSGVPSRFSGSGSGTDFTLTISSLQPEDSATYYCQQYWTFPLTFGGGTKVEIK

SEQ ID NO: 102 - protein, 107 aa, Artificial Sequence
  Description of Artificial Sequence: Synthetic polypeptide
DIQMTQSPSSLSASLGDRVTITCRASQGISSYLAWYQQKPGKAPKLLIYANSTAQSGVPSRFSGSGSGTEFTLTISSLQPEDSATYYCQQYWRWPLTFGGGTKVEIK

SEQ ID NO: 103 - protein, 107 aa, Artificial Sequence; identical to SEQ ID NO: 42
  Description of Artificial Sequence: Synthetic polypeptide

SEQ ID NO: 104 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTTQSGVPSRFSGSGSGTDFTLTISSLQPEDSATYYCQQYWTFPLTFGGGTKVEIK

SEQ ID NO: 105 - protein, 107 aa, Artificial Sequence; identical to SEQ ID NO: 37
  Description of Artificial Sequence: Synthetic polypeptide

SEQ ID NO: 106 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAQSTLQSGVPSRFSGSGSGTDFTLTISSLQPEDSGTYYCQQYWRFPLTFGGGTKVEIK

SEQ ID NO: 107 - protein, 107 aa, Artificial Sequence
  Description of Artificial Sequence: Synthetic polypeptide
DIQMTQSPSSLSASLGDRVTITCRASQGISSYLAWYQQKPGKAPKLLIYATSTAQSGVPSRFSGSGSGTDFTLTISSLQPEDSGTYYCQQYWMFPLTFGGGTKVEIK

SEQ ID NO: 108 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTTQSGVPSRFSGSGSGTEFTLTISSLQPEDSGTYYCQQYWSFPLTFGGGTKVEIK

SEQ ID NO: 109 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAPSTPQSGVPSRFSGSGSGTEFTLTISSLQPEDSATYYCQQYWMFPLTFGGGTKVEIK

SEQ ID NO: 110 - protein, 107 aa, Artificial Sequence; identical to SEQ ID NO: 43
  Description of Artificial Sequence: Synthetic polypeptide

SEQ ID NO: 111 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTLQSGVPSRFSGSGSGTEFTLTISSLQPEDSGTYYCQQYWTWPLTFGGGTKVEIK

SEQ ID NO: 112 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTRQSGVPSRFSGSGSGTDFTLTISSLQPEDSGTYYCQQYWSFPLTFGGGTKVEIK

SEQ ID NO: 113 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTPQSGVPSRFSGSGSGTEFTLTISSLQPEDSATYYCQQYWRFPLTFGGGTKVEIK

SEQ ID NO: 114 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTTQSGVPSRFSGSGSGTDFTLTISSLQPEDSGTYYCQQYWRWPLTFGGGTKVEIK

SEQ ID NO: 115 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTSQSGVPSRFSGSGSGTDFTLTISSLQPEDSATYYCQQYWQFPLTFGGGTKVEIK

SEQ ID NO: 116 - protein, 107 aa, Artificial Sequence; identical to SEQ ID NO: 32
  Description of Artificial Sequence: Synthetic polypeptide

SEQ ID NO: 117 - protein, 107 aa, Artificial Sequence; identical to SEQ ID NO: 43
  Description of Artificial Sequence: Synthetic polypeptide

SEQ ID NO: 118 - protein, 107 aa, Artificial Sequence
  Description of Artificial Sequence: Synthetic polypeptide
DIQMTQSPSSLSASLGDRVTITCRASQGISSYLAWYQQKPGKAPKLLIYATSTAQSGVPSRFSGSGSGTDFTLTISSLQPEDSATYYCQQYWFWPLTFGGGTKVEIK

SEQ ID NO: 119 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTRQSGVPSRFSGSGSGTEFTLTISSLQPEDSATYYCQQYWLFPLTFGGGTKVEIK

SEQ ID NO: 120 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTRQSGVPSRFSGSGSGTEFTLTISSLQPEDSGTYYCQQYWWFPLTFGGGTKVEIK

SEQ ID NO: 121 - protein, 107 aa, Artificial Sequence; identical to SEQ ID NO: 109
  Description of Artificial Sequence: Synthetic polypeptide

SEQ ID NO: 122 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTYQSGVPSRFSGSGSGTEFTLTISSLQPEDSGTYYCQQYWRWPLTFGGGTKVEIK

SEQ ID NO: 123 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTIQSGVPSRFSGSGSGTEFTLTISSLQPEDSATYYCQQYWTFPLTFGGGTKVEIK

SEQ ID NO: 124 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTPQSGVPSRFSGSGSGTEFTLTISSLQPEDSATYYCQQYWLFPLTFGGGTKVEIK

SEQ ID NO: 125 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTLQSGVPSRFSGSGSGTDFTLTISSLQPEDSGTYYCQQYWFFPLTFGGGTKVEIK

SEQ ID NO: 126 - protein, 107 aa, Artificial Sequence; identical to SEQ ID NO: 33
  Description of Artificial Sequence: Synthetic polypeptide

SEQ ID NO: 127 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTHQSGVPSRFSGSGSGTEFTLTISSLQPEDSGTYYCQQYWTFPLTFGGGTKVEIK

SEQ ID NO: 128 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTRQSGVPSRFSGSGSGTEFTLTISSLQPEDSATYYCQQYWVWPLTFGGGTKVEIK

SEQ ID NO: 129 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTRQSGVPSRFSGSGSGTDFTLTISSLQPEDSATYYCQQYWTWPLTFGGGTKVEIK

SEQ ID NO: 130 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTRQSGVPSRFSGSGSGTEFTLTISSLQPEDSGTYYCQQYWTWPLTFGGGTKVEIK

SEQ ID NO: 131 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTLQSGVPSRFSGSGSGTEFTLTISSLQPEDSGTYYCQQYWTFPLTFGGGTKVEIK

SEQ ID NO: 132 - protein, 107 aa, Artificial Sequence
  Description of Artificial Sequence: Synthetic polypeptide
DIQMTQSPSSLSASLGDRVTITCRASQGISSYLAWYQQKPGKAPKLLIYADSTSQSGVPSRFSGSGSGTEFTLTISSLQPEDSATYYCQQYWTFPLTFGGGTKVEIK

SEQ ID NO: 133 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTPQSGVPSRFSGSGSGTEFTLTISSLQPEDSGTYYCQQYWTWPLTFGGGTKVEIK

SEQ ID NO: 134 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSS

SEQ ID NO: 135 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSS

SEQ ID NO: 136 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSS

SEQ ID NO: 137 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSS

SEQ ID NO: 138 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSS

SEQ ID NO: 139 - protein, 122 aa, Artificial Sequence; identical to SEQ ID NO: 136
  Description of Artificial Sequence: Synthetic polypeptide

SEQ ID NO: 140 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSS

SEQ ID NO: 141 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSS

SEQ ID NO: 142 - protein, 122 aa, Artificial Sequence
  Description of Artificial Sequence: Synthetic polypeptide
QVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSS

SEQ ID NO: 143 - protein, 122 aa, Artificial Sequence
  Description of Artificial Sequence: Synthetic polypeptide
QVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSS

SEQ ID NO: 144 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCARDLGAKQWLEGFDYWGQGTLVTVSS

SEQ ID NO: 145 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSMGYADSVKGRFTISRDNAKNSLYLQMNSLRAEDTALYYCARDLGAFQWEEGFDYWGQGTLVTVSS

SEQ ID NO: 146 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSSGYADSVKGRFTISRDNAKNSLYLQMNSLRAEDTALYYCARDLGAFQWQEGFDYWGQGTLVTVSS

SEQ ID NO: 147 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGAMQWVEGFDYWGQGTLVTVSS

SEQ ID NO: 148 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCARDLGFNQWNEGFDYWGQGTLVTVSS

SEQ ID NO: 149 - protein, 122 aa, Artificial Sequence; identical to SEQ ID NO: 148
  Description of Artificial Sequence: Synthetic polypeptide

SEQ ID NO: 150 - protein, 122 aa, Artificial Sequence; identical to SEQ ID NO: 148
  Description of Artificial Sequence: Synthetic polypeptide

SEQ ID NO: 151 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCARDLGFNQWLEGFDYWGQGTLVTVSS

SEQ ID NO: 152 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSNGYADSVKGRFTISRDNAKNSLYLQMNSLRAEDTALYYCARDLGFMQWVDGFDYWGQGTLVTVSS

SEQ ID NO: 153 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWVEGFDYWGQGTLVTVSS

SEQ ID NO: 154 - protein, 122 aa, Artificial Sequence; identical to SEQ ID NO: 141
  Description of Artificial Sequence: Synthetic polypeptide

SEQ ID NO: 155 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLDGFDYWGQGTLVTVSS

SEQ ID NO: 156 - protein, 122 aa, Artificial Sequence; identical to SEQ ID NO: 141
  Description of Artificial Sequence: Synthetic polypeptide

SEQ ID NO: 157 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSSGYADSVKGRFTISRDNAKNSLYLQMNSLRAEDTALYYCARDLGYNQWLEGFDYWGQGTLVTVSS

SEQ ID NO: 158 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSMGYADSVKGRFTISRDNAKNSLYLQMNSLRAEDTALYYCARDLGYNQWLEGFDYWGQGTLVTVSS

SEQ ID NO: 159 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSRGYADSVKGRFTISRDNAKNSLYLQMNSLRAEDTALYYCARDLGYNQWLEGFDYWGQGTLVTVSS

SEQ ID NO: 160 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGYNQWQEGFDYWGQGTLVTVSS

SEQ ID NO: 161 - protein, 122 aa, Artificial Sequence; identical to SEQ ID NO: 137
  Description of Artificial Sequence: Synthetic polypeptide

SEQ ID NO: 162 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSLGYADSVKGRFTISRDNAKNSLYLQMNSLRAEDTALYYCARDLGYSQWVEGFDYWGQGTLVTVSS

SEQ ID NO: 163 - protein, 122 aa, Artificial Sequence; identical to SEQ ID NO: 134
  Description of Artificial Sequence: Synthetic polypeptide

SEQ ID NO: 164 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSSGYADSVKGRFTISRDNAKNSLYLQMNSLRAEDTALYYCARDLGFNQWVEGFDYWGQGTLVTVSS

SEQ ID NO: 165 - protein, 122 aa, Artificial Sequence; identical to SEQ ID NO: 152
  Description of Artificial Sequence: Synthetic polypeptide

SEQ ID NO: 166 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDWPGNQWVFGGGTKVTVLG

SEQ ID NO: 167 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDVPGDQWVFGGGTKVTVLG

SEQ ID NO: 168 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 169 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVIG

SEQ ID NO: 170 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 171 - protein, 109 aa, Artificial Sequence; identical to SEQ ID NO: 168
  Description of Artificial Sequence: Synthetic polypeptide

SEQ ID NO: 172 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 173 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 174 - protein, 109 aa, Artificial Sequence
  Description of Artificial Sequence: Synthetic polypeptide
SYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 175 - protein, 109 aa, Artificial Sequence
  Description of Artificial Sequence: Synthetic polypeptide
SYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 176 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGNSWVFGGGTKVTVLG

SEQ ID NO: 177 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDSPGNVWVFGGGTKVTVLG

SEQ ID NO: 178 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGNRWVFGGGTKVTVLG

SEQ ID NO: 179 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNTWVFGGGTKVTVLG

SEQ ID NO: 180 - protein, 109 aa, Artificial Sequence; identical to SEQ ID NO: 179
  Description of Artificial Sequence: Synthetic polypeptide

SEQ ID NO: 181 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVLG

SEQ ID NO: 182 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDVPGNQWVFGGGTKVTVLG

SEQ ID NO: 183 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDNPGNQWVFGGGTKVTVLG

SEQ ID NO: 184 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDHPGNNWVFGGGTKVTVLG

SEQ ID NO: 185 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGNQWVFGGGTKVTVIG

SEQ ID NO: 186 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGDKWVFGGGTKVTVLG

SEQ ID NO: 187 - protein, 109 aa, Artificial Sequence; identical to SEQ ID NO: 186
  Description of Artificial Sequence: Synthetic polypeptide

SEQ ID NO: 188 - protein, 109 aa, Artificial Sequence; identical to SEQ ID NO: 186
  Description of Artificial Sequence: Synthetic polypeptide

SEQ ID NO: 189 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGDQWVFGGGTKVTVLG

SEQ ID NO: 190 - protein, 109 aa, Artificial Sequence; identical to SEQ ID NO: 167
  Description of Artificial Sequence: Synthetic polypeptide

SEQ ID NO: 191 - protein, 109 aa, Artificial Sequence; identical to SEQ ID NO: 168
  Description of Artificial Sequence: Synthetic polypeptide

SEQ ID NO: 192 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDYPGNNWVFGGGTKVTVLG

SEQ ID NO: 193 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDYPGNHWVFGGGTKVTVLG

SEQ ID NO: 194 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDAPGDQWVFGGGTKVTVLG

SEQ ID NO: 195 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGNQWVFGGGTKVTVLG

SEQ ID NO: 196 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGNNWVFGGGTKVTVLG

SEQ ID NO: 197 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGNNWVFGGGTKVTVLG

SEQ ID NO: 198 - protein, 109 aa, Artificial Sequence; identical to SEQ ID NO: 166
  Description of Artificial Sequence: Synthetic polypeptide

SEQ ID NO: 199 - protein, 109 aa, Artificial Sequence; identical to SEQ ID NO: 166
  Description of Artificial Sequence: Synthetic polypeptide

SEQ ID NO: 200 - protein, 109 aa, Artificial Sequence; identical to SEQ ID NO: 167
  Description of Artificial Sequence: Synthetic polypeptide

SEQ ID NO: 201 - DNA, 648 bp, Artificial Sequence
  Description of Artificial Sequence: Synthetic polynucleotide
gacattcagatgacccagagcccctcatcactgtccgcgtcaacgggggatagggtcactatcacttgcagagcatcgcaggggatcagctcctatctcgcgtggtatcagcagaagccaggaaaggcaccgaagctgcttatctacgccgcctcgacattgcagtcgggcgtacctagccgcttctcgggatcaggatcgggtacggactttactttgacaattagcagcctccaacccgaggatttcgctacgtactattgccagcagtacttcacatttccgttgaccttcggtggagggactaaggtggagatcaagcgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataa

SEQ ID NO: 202 - protein, 214 aa, Artificial Sequence
  Description of Artificial Sequence: Synthetic polypeptide
DIQMTQSPSSLSASTGDRVTITCRASQGISSYLAWYQQKPGKAPKLLIYAASTLQSGVPSRFSGSGSGTDFTLTISSLQPEDFATYYCQQYFTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 203 - DNA, 648 bp, Artificial Sequence
  Description of Artificial Sequence: Synthetic polynucleotide
gatattcaaatgacacagtcaccctcgtcactcagcgccagccttggggaccgcgtaacgatcacgtgtagagcgtcgcaggggatttcctcgtatctggcgtggtatcagcaaaagcctggtaaagctccgaaactcctgatctacgccaagtcgaccttgcagtccggagtcccctcaaggttcagcgggtcgggatccggtacagatttcaccctgaccatctcaagcctccagccagaggactccgcaacgtactattgccagcagtactggacgtttcctttgacttttggaggcggaacaaaggtggaaatcaaacgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataa

SEQ ID NO: 204 - protein, 214 aa, Artificial Sequence
  Description of Artificial Sequence: Synthetic polypeptide
DIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - DNA, 648 bp, Artificial Sequence
  Description of Artificial Sequence: Synthetic polynucleotide
gatatccagatgacacagtcaccgtcctcattgtcagcgtcgctgggggaccgagtgacgattacgtgtcgcgcgtcacaggggatctccagctatctcgcgtggtatcaacagaagccgggcaaagcccccaagctccttatctacgcctccagcacaagacaaagcggagtaccaagccggttctcggggtcgggatcgggaacagactttacacttactatttcgtcgctgcagcccgaagattcgggaacctactattgccagcagtactgggcattccccctgacgttcggcggtggtactaaagtcgagatcaagcgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataa

SEQ ID NO: 206 - protein, 214 aa, Artificial Sequence
  Description of Artificial Sequence: Synthetic polypeptide
DIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - DNA, 648 bp, Artificial Sequence
  Description of Artificial Sequence: Synthetic polynucleotide
gatatccagttgacccagtcgccctcgtccctctcggcatcactgggtgaccgggtgactattacgtgtagagcgtcacagggaatctcaagctatttggcctggtatcagcaaaagccggggaaagcccctaagctcctgatctacgcgcgctcgacgcgacagagcggagtacccagcaggttttccggatcggggtcaggtacagaattcacccttacgatttcgtcgctccaacccgaggactccgcgacgtactactgccagcaatactggacttggccgctcacgtttgggggaggcacgaaggtcgagatcaaacgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataa

SEQ ID NO: 208 - protein, 214 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 209 - DNA, 2166 bp, Artificial Sequence
  Description of Artificial Sequence: Synthetic polynucleotide
gaggtgcagctcctccaaagcggagggggtttggtccagcccggtggctcgttgcgcctctcatgtgccgcgtcggggtttacattcagcgtctatccgatgcactgggtacgacaggcgccagggaaaggactggagtgggtgtcatcgatcagcagctccggaggtgctacaagatatgccgactcggtgaaaggccgctttacgatcagccgcgataacagcaagaatacgttgtacctccaaatgaactcgctgcgagccgaggacactgcggtgtactattgcgcgaaggatttctatgacatccttactggtaatgcgtttgatatctggggccaggggacaacggtcaccgtgagctcggccagcacgaaggggcctagcgtctttccgctcgccccctcgtcaaaatcaacgtcgggtggaacggccgcattgggttgtctcgtaaaggactactttccggaacccgtcaccgtatcgtggaattcaggcgccctgacttccggggtccacacctttcccgctgtcttgcagtcctcgggtttgtattcactgtcgtcagtggtgacagtaccatcatcctcactgggaactcaaacgtacatctgcaacgtgaaccacaagccgagcaacactaaggtggataagaaggtagagcccaagtcatgcgacaaaacgcatacatgcccgccatgccccgcaccagaacttttgggaggtccgtcagtgtttctctttccgcctaagcccaaagacacactgatgatttcccggacgcccgaagtcacttgtgtggtcgtcgacgtgtcccatgaagatcccgaagtaaagttcaactggtatgtcgacggtgtggaagtccacaatgcaaaaaccaagcccagggaagaacagtacaacagcacatatcgagtggtgagcgtgttgaccgtgctgcaccaagactggctcaatggaaaggagtacaaatgcaaagtgtccaacaaggcactgcctgcgcccattgagaaaacgatttcgaaagcaaagggacagccaagagaaccccaagtgtatacccttcccccgtcgcgcgaggaaatgacgaagaaccaggtatcgttgacgtgtcttgtaaagggattctatccctcggacatcgcggtcgagtgggagtccaacggacagccagagaataactacaaaaccacaccgcctgtgctggattccgacgggtcgtttttcttgtattcgaagcttacggtagacaaaagccggtggcagcagggtaatgtgttcagctgctcagtaatgcacgaggctctccataatcattacactcagaagtccctttccctttcgccgggagggggtgggggatccggcggaggtgggtcgggaggtggaggatcacaagtgcaattggtacagtcgggaggcgggcttgtgcaacccggagggtcactgcgcctttcatgtgcggcgagcggtttcacgttcgatgattatgcgatgcattgggtacggcaggcacctggcaaagggttggagtgggtagccggaatctcgtggaatagcgggagcatcggttatgcggattccgtcaaagggaggtttacaatttcgagggacaatgcgaagaacagcctgtatctccaaatgaattcgctcaggcccgaagataccgccgtctactactgcgcgagggacttgggatacaaccagtgggtggaagggtttgattactgggggcaggggactctggtaactgtctcatcggcatcgactggtggtggcgggtccggagggggaggaagcggaggaggcgggagcggaggcggtgggtccagctacgaactgactcaagatccggccgtatcggtggccctcggacaaacagtgcgaatcacctgtcagggggatagccttagatcgtactacgcttcgtggtatcagcaaaagcccggacaggcaccagtgcttgtgatctacggaaagaacaatagaccgagcggaattccggatcggttttcgggttcgacttccggaaattcggcgtcgctcacgatcaccggagctcaggcagaggatgaagcggattactattgtaattcccgcgattcgtcggggaatcattgggtgttcggtgggggtacaaaggtaactgtactcggctgataa

SEQ ID NO: 210 - protein, 720 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 211 - DNA, 2154 bp, Artificial Sequence
  Description of Artificial Sequence: Synthetic polynucleotide
gaggtccagctcctccagtcaggtggaggactggtgcaacccggaggttcacttcggctgtcgtgtgcggcatcgggattcacgttttcggtgtatccgatgcattgggtgcgacaagctccgggcaaagggcttgaatgggtgtcgtccatctcgtcgtcgggaggagcaacgaggtatgccgattccgtaaagggtaggttcaccatctcacgcgacaattccaagaatacgttgtacctgcagatgaattcgcttagggcagaagatacggccgtgtactattgcgcaaaagatttctatgacattcttactggtaatgcgttcgatatctggggtcagggaactaccgtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtgggactcggggtccacgggctatgcggactcggtcaaggggcgcttcacaatctcaagggacaatgccaaaaactcgctctatcttcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtgaatcgcgagattcccctggtaatcagtgggtctttgggggaggaactaaggtaacggtattggggtgataa

SEQ ID NO: 212 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 213 - DNA, 2169 bp, Artificial Sequence
  Description of Artificial Sequence: Synthetic polynucleotide
gaggtccagctcctccagtcaggtggaggactggtgcaacccggaggttcacttcggctgtcgtgtgcggcatcgggattcacgttttcggtgtatccgatgcattgggtgcgacaagctccgggcaaagggcttgaatgggtgtcgtccatctcgtcgtcgggaggagcaacgaggtatgccgattccgtaaagggtaggttcaccatctcacgcgacaattccaagaatacgttgtacctgcagatgaattcgcttagggcagaagatacggccgtgtactattgcgcaaaagatttctatgacattcttactggtaatgcgttcgatatctggggtcagggaactaccgtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcgcaagtgcagctggtgcaaagcggaggtgggcttgtccaacccggaggctcacttagattgtcatgtgcggcgagcggttttacctttgacgattatgcgatgcactgggtccgccaggcaccggggaaggggctcgaatgggtagccggaatctcgtgggactcggggtccacgggctatgcggactcggtcaaggggcgcttcacaatctcaagggacaatgccaaaaactcgctctatctgcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcaggaggtgggggatcgtcatacgagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctccacctcagggaactcggcctcgttgactatcacgggtgcgcaagccgaggacgaggcagactattactgtaactcgcgagattcccctggtaatcagtgggtctttgggggaggaactaaggtaacggtattggggtgataa

SEQ ID NO: 214 - protein, 720 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 215 - DNA, 2154 bp, Artificial Sequence
  Description of Artificial Sequence: Synthetic polynucleotide
gaggtccagctcctccagtcaggtggaggactggtgcaacccggaggttcacttcggctgtcgtgtgcggcatcgggattcacgttttcggtgtatccgatgcattgggtgcgacaagctccgggcaaagggcttgaatgggtgtcgtccatctcgtcgtcgggaggagcaacgaggtatgccgattccgtaaagggtaggttcaccatctcacgcgacaattccaagaatacgttgtacctgcagatgaattcgcttagggcagaagatacggccgtgtactattgcgcaaaagatttctatgacattcttactggtaatgcgttcgatatctggggtcagggaactaccgtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaattcggggtccacgggctatgcggactcggtcaaggggcgcttcacaatctcaagggacaatgccaaaaactcgctctatttgcaaatgaactcattgcgagctgaggacacggcgctttactactgtgcgcgggatttgggctttaaccaatgggtagacgggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtaactcgcgagatacgcctggtgaccagtgggtctttgggggaggaactaaggtaacggtattggggtgataa

SEQ ID NO: 216 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 217 - DNA, 2154 bp, Artificial Sequence
  Description of Artificial Sequence: Synthetic polynucleotide
gaggtccagctcctccagtcaggtggaggactggtgcaacccggaggttcacttcggctgtcgtgtgcggcatcgggattcacgttttcggtgtatccgatgcattgggtgcgacaagctccgggcaaagggcttgaatgggtgtcgtccatctcgtcgtcgggaggagcaacgaggtatgccgattccgtaaagggtaggttcaccatctcacgcgacaattccaagaatacgttgtacctgcagatgaattcgcttagggcagaagatacggccgtgtactattgcgcaaaagatttctatgacattcttactggtaatgcgttcgatatctggggtcagggaactaccgtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccacgggctatgcggactcggtcaaggggcgcttcacaatctcaagggacaatgccaaaaactcgctctatctccagatgaactcattgcgagctgaggacacggcgctttactactgtgcgcgggatttgggttacaaccaatggcttgaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagatcaccctggtaatcagtgggtctttgggggaggaactaaggtaacggtattggggtgataa

SEQ ID NO: 218 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 219 - DNA, 2154 bp, Artificial Sequence
  Description of Artificial Sequence: Synthetic polynucleotide
gaggtccagctcctccagtcaggtggaggactggtgcaacccggaggttcacttcggctgtcgtgtgcggcatcgggattcacgttttcggtgtatccgatgcattgggtgcgacaagctccgggcaaagggcttgaatgggtgtcgtccatctcgtcgtcgggaggagcaacgaggtatgccgattccgtaaagggtaggttcaccatctcacgcgacaattccaagaatacgttgtacctgcagatgaattcgcttagggcagaagatacggccgtgtactattgcgcaaaagatttctatgacattcttactggtaatgcgttcgatatctggggtcagggaactaccgtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccgtgggctatgcggactcggtcaaggggcgcttcacaatctcaagggacaatgccaaaaactcgctctacttgcagatgaactcattgcgagctgaggacacggcgctttactactgtgcgcgggatttgggctacaatcaatggttggaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagattcccctggtaatcagtgggtctttgggggaggaactaaggtaacggtattggggtgataa

SEQ ID NO: 220 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 221 - DNA, 2166 bp, Artificial Sequence
  Description of Artificial Sequence: Synthetic polynucleotide
gaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcacgaaggggcctagcgtctttccgctcgccccctcgtcaaaatcaacgtcgggtggaacggccgcattgggttgtctcgtaaaggactactttccggaacccgtcaccgtatcgtggaattcaggcgccctgacttccggggtccacacctttcccgctgtcttgcagtcctcgggtttgtattcactgtcgtcagtggtgacagtaccatcatcctcactgggaactcaaacgtacatctgcaacgtgaaccacaagccgagcaacactaaggtggataagaaggtagagcccaagtcatgcgacaaaacgcatacatgcccgccatgccccgcaccagaacttttgggaggtccgtcagtgtttctctttccgcctaagcccaaagacacactgatgatttcccggacgcccgaagtcacttgtgtggtcgtcgacgtgtcccatgaagatcccgaagtaaagttcaactggtatgtcgacggtgtggaagtccacaatgcaaaaaccaagcccagggaagaacagtacaacagcacatatcgagtggtgagcgtgttgaccgtgctgcaccaagactggctcaatggaaaggagtacaaatgcaaagtgtccaacaaggcactgcctgcgcccattgagaaaacgatttcgaaagcaaagggacagccaagagaaccccaagtgtatacccttcccccgtcgcgcgaggaaatgacgaagaaccaggtatcgttgacgtgtcttgtaaagggattctatccctcggacatcgcggtcgagtgggagtccaacggacagccagagaataactacaaaaccacaccgcctgtgctggattccgacgggtcgtttttcttgtattcgaagcttacggtagacaaaagccggtggcagcagggtaatgtgttcagctgctcagtaatgcacgaggctctccataatcattacactcagaagtccctttccctttcgccgggagggggtgggggatccggcggaggtgggtcgggaggtggaggatcacaagtgcaattggtacagtcgggaggcgggcttgtgcaacccggagggtcactgcgcctttcatgtgcggcgagcggtttcacgttcgatgattatgcgatgcattgggtacggcaggcacctggcaaagggttggagtgggtagccggaatctcgtggaatagcgggagcatcggttatgcggattccgtcaaagggaggtttacaatttcgagggacaatgcgaagaacagcctgtatctccaaatgaattcgctcaggcccgaagataccgccgtctactactgcgcgagggacttgggatacaaccagtgggtggaagggtttgattactgggggcaggggactctggtaactgtctcatcggcatcgactggtggtggcgggtccggagggggaggaagcggaggaggcgggagcggaggcggtgggtccagctacgaactgactcaagatccggccgtatcggtggccctcggacaaacagtgcgaatcacctgtcagggggatagccttagatcgtactacgcttcgtggtatcagcaaaagcccggacaggcaccagtgcttgtgatctacggaaagaacaatagaccgagcggaattccggatcggttttcgggttcgacttccggaaattcggcgtcgctcacgatcaccggagctcaggcagaggatgaagcggattactattgtaattcccgcgattcgtcggggaatcattgggtgttcggtgggggtacaaaggtaactgtactcggctgataa

SEQ ID NO: 222 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 223 - DNA, 2154 bp, Artificial Sequence
  Description of Artificial Sequence: Synthetic polynucleotide
gaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtgggactcggggtccacgggctatgcggactcggtcaaggggcgcttcacaatctcaagggacaatgccaaaaactcgctctatcttcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtgaatcgcgagattcccctggtaatcagtgggtctttgggggaggaactaaggtaacggtattggggtgataa

SEQ ID NO: 224 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 225 - DNA, 2169 bp, Artificial Sequence
  Description of Artificial Sequence: Synthetic polynucleotide
gaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcgcaagtgcagctggtgcaaagcggaggtgggcttgtccaacccggaggctcacttagattgtcatgtgcggcgagcggttttacctttgacgattatgcgatgcactgggtccgccaggcaccggggaaggggctcgaatgggtagccggaatctcgtgggactcggggtccacgggctatgcggactcggtcaaggggcgcttcacaatctcaagggacaatgccaaaaactcgctctatctgcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcaggaggtgggggatcgtcatacgagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctccacctcagggaactcggcctcgttgactatcacgggtgcgcaagccgaggacgaggcagactattactgtaactcgcgagattcccctggtaatcagtgggtctttgggggaggaactaaggtaacggtattggggtgataa

SEQ ID NO: 226 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 227 - DNA, 2154 bp, Artificial Sequence
  Description of Artificial Sequence: Synthetic polynucleotide
gaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaattcggggtccacgggctatgcggactcggtcaaggggcgcttcacaatctcaagggacaatgccaaaaactcgctctatttgcaaatgaactcattgcgagctgaggacacggcgctttactactgtgcgcgggatttgggctttaaccaatgggtagacgggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtaactcgcgagatacgcctggtgaccagtgggtctttgggggaggaactaaggtaacggtattggggtgataa

SEQ ID NO: 228 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 229 - DNA, 2154 bp, Artificial Sequence
  Description of Artificial Sequence: Synthetic polynucleotide
gaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccacgggctatgcggactcggtcaaggggcgcttcacaatctcaagggacaatgccaaaaactcgctctatctccagatgaactcattgcgagctgaggacacggcgctttactactgtgcgcgggatttgggttacaaccaatggcttgaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagatcaccctggtaatcagtgggtctttgggggaggaactaaggtaacggtattggggtgataa

SEQ ID NO: 230 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 231 - DNA, 2154 bp, Artificial Sequence
  Description of Artificial Sequence: Synthetic polynucleotide
gaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccgtgggctatgcggactcggtcaaggggcgcttcacaatctcaagggacaatgccaaaaactcgctctacttgcagatgaactcattgcgagctgaggacacggcgctttactactgtgcgcgggatttgggctacaatcaatggttggaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagattcccctggtaatcagtgggtctttgggggaggaactaaggtaacggtattggggtgataa

SEQ ID NO: 232 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 233 - DNA, 2166 bp, Artificial Sequence
  Description of Artificial Sequence: Synthetic polynucleotide
gaagtacagcttttgcaaagcgggggtggcttggtccagcccggagggtccttgaggctctcgtgtgcggcctcagggttcgacttttcgtcgtatcccatgcactgggtccgccaggcccctggtaaagggctggagtgggtaggatccattagctcctcgggaggggcaactccgtatgcggattcagtgaaaggccgattcacaatctcgcgggataactcgaagaacaccctgtaccttcaaatgaattcactcagaccagaggacacggcagtctactattgcgctaaggacttttacactatcttgacgggaaatgcgtttgatatgtggggacagggaacctcagtgacggtcagctcagctagcacgaaggggcctagcgtctttccgctcgccccctcgtcaaaatcaacgtcgggtggaacggccgcattgggttgtctcgtaaaggactactttccggaacccgtcaccgtatcgtggaattcaggcgccctgacttccggggtccacacctttcccgctgtcttgcagtcctcgggtttgtattcactgtcgtcagtggtgacagtaccatcatcctcactgggaactcaaacgtacatctgcaacgtgaaccacaagccgagcaacactaaggtggataagaaggtagagcccaagtcatgcgacaaaacgcatacatgcccgccatgccccgcaccagaacttttgggaggtccgtcagtgtttctctttccgcctaagcccaaagacacactgatgatttcccggacgcccgaagtcacttgtgtggtcgtcgacgtgtcccatgaagatcccgaagtaaagttcaactggtatgtcgacggtgtggaagtccacaatgcaaaaaccaagcccagggaagaacagtacaacagcacatatcgagtggtgagcgtgttgaccgtgctgcaccaagactggctcaatggaaaggagtacaaatgcaaagtgtccaacaaggcactgcctgcgcccattgagaaaacgatttcgaaagcaaagggacagccaagagaaccccaagtgtatacccttcccccgtcgcgcgaggaaatgacgaagaaccaggtatcgttgacgtgtcttgtaaagggattctatccctcggacatcgcggtcgagtgggagtccaacggacagccagagaataactacaaaaccacaccgcctgtgctggattccgacgggtcgtttttcttgtattcgaagcttacggtagacaaaagccggtggcagcagggtaatgtgttcagctgctcagtaatgcacgaggctctccataatcattacactcagaagtccctttccctttcgccgggagggggtgggggatccggcggaggtgggtcgggaggtggaggatcacaagtgcaattggtacagtcgggaggcgggcttgtgcaacccggagggtcactgcgcctttcatgtgcggcgagcggtttcacgttcgatgattatgcgatgcattgggtacggcaggcacctggcaaagggttggagtgggtagccggaatctcgtggaatagcgggagcatcggttatgcggattccgtcaaagggaggtttacaatttcgagggacaatgcgaagaacagcctgtatctccaaatgaattcgctcaggcccgaagataccgccgtctactactgcgcgagggacttgggatacaaccagtgggtggaagggtttgattactgggggcaggggactctggtaactgtctcatcggcatcgactggtggtggcgggtccggagggggaggaagcggaggaggcgggagcggaggcggtgggtccagctacgaactgactcaagatccggccgtatcggtggccctcggacaaacagtgcgaatcacctgtcagggggatagccttagatcgtactacgcttcgtggtatcagcaaaagcccggacaggcaccagtgcttgtgatctacggaaagaacaatagaccgagcggaattccggatcggttttcgggttcgacttccggaaattcggcgtcgctcacgatcaccggagctcaggcagaggatgaagcggattactattgtaattcccgcgattcgtcggggaatcattgggtgttcggtgggggtacaaaggtaactgtactcggctgataa

SEQ ID NO: 234 - protein, 720 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 235 - DNA, 2154 bp, Artificial Sequence
  Description of Artificial Sequence: Synthetic polynucleotide
gaagtacagcttttgcaaagcgggggtggcttggtccagcccggagggtccttgaggctctcgtgtgcggcctcagggttcgacttttcgtcgtatcccatgcactgggtccgccaggcccctggtaaagggctggagtgggtaggatccattagctcctcgggaggggcaactccgtatgcggattcagtgaaaggccgattcacaatctcgcgggataactcgaagaacaccctgtaccttcaaatgaattcactcagaccagaggacacggcagtctactattgcgctaaggacttttacactatcttgacgggaaatgcgtttgatatgtggggacagggaacctcagtgacggtcagctcagctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtgggactcggggtccacgggctatgcggactcggtcaaggggcgcttcacaatctcaagggacaatgccaaaaactcgctctatcttcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtgaatcgcgagattcccctggtaatcagtgggtctttgggggaggaactaaggtaacggtattggggtgataa

SEQ ID NO: 236 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 237 - DNA, 2169 bp, Artificial Sequence
  Description of Artificial Sequence: Synthetic polynucleotide
gaagtacagcttttgcaaagcgggggtggcttggtccagcccggagggtccttgaggctctcgtgtgcggcctcagggttcgacttttcgtcgtatcccatgcactgggtccgccaggcccctggtaaagggctggagtgggtaggatccattagctcctcgggaggggcaactccgtatgcggattcagtgaaaggccgattcacaatctcgcgggataactcgaagaacaccctgtaccttcaaatgaattcactcagaccagaggacacggcagtctactattgcgctaaggacttttacactatcttgacgggaaatgcgtttgatatgtggggacagggaacctcagtgacggtcagctcagctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcgcaagtgcagctggtgcaaagcggaggtgggcttgtccaacccggaggctcacttagattgtcatgtgcggcgagcggttttacctttgacgattatgcgatgcactgggtccgccaggcaccggggaaggggctcgaatgggtagccggaatctcgtgggactcggggtccacgggctatgcggactcggtcaaggggcgcttcacaatctcaagggacaatgccaaaaactcgctctatctgcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcaggaggtgggggatcgtcatacgagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctccacctcagggaactcggcctcgttgactatcacgggtgcgcaagccgaggacgaggcagactattactgtaactcgcgagattcccctggtaatcagtgggtctttgggggaggaactaaggtaacggtattggggtgataa

SEQ ID NO: 238 - protein, 720 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 239 - DNA, 2154 bp, Artificial Sequence
  Description of Artificial Sequence: Synthetic polynucleotide
gaagtacagcttttgcaaagcgggggtggcttggtccagcccggagggtccttgaggctctcgtgtgcggcctcagggttcgacttttcgtcgtatcccatgcactgggtccgccaggcccctggtaaagggctggagtgggtaggatccattagctcctcgggaggggcaactccgtatgcggattcagtgaaaggccgattcacaatctcgcgggataactcgaagaacaccctgtaccttcaaatgaattcactcagaccagaggacacggcagtctactattgcgctaaggacttttacactatcttgacgggaaatgcgtttgatatgtggggacagggaacctcagtgacggtcagctcagctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaattcggggtccacgggctatgcggactcggtcaaggggcgcttcacaatctcaagggacaatgccaaaaactcgctctatttgcaaatgaactcattgcgagctgaggacacggcgctttactactgtgcgcgggatttgggctttaaccaatgggtagacgggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtaactcgcgagatacgcctggtgaccagtgggtctttgggggaggaactaaggtaacggtattggggtgataa

SEQ ID NO: 240 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 241 - DNA, 2154 bp, Artificial Sequence
  Description of Artificial Sequence: Synthetic polynucleotide
gaagtacagcttttgcaaagcgggggtggcttggtccagcccggagggtccttgaggctctcgtgtgcggcctcagggttcgacttttcgtcgtatcccatgcactgggtccgccaggcccctggtaaagggctggagtgggtaggatccattagctcctcgggaggggcaactccgtatgcggattcagtgaaaggccgattcacaatctcgcgggataactcgaagaacaccctgtaccttcaaatgaattcactcagaccagaggacacggcagtctactattgcgctaaggacttttacactatcttgacgggaaatgcgtttgatatgtggggacagggaacctcagtgacggtcagctcagctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccacgggctatgcggactcggtcaaggggcgcttcacaatctcaagggacaatgccaaaaactcgctctatctccagatgaactcattgcgagctgaggacacggcgctttactactgtgcgcgggatttgggttacaaccaatggcttgaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagatcaccctggtaatcagtgggtctttgggggaggaactaaggtaacggtattggggtgataa

SEQ ID NO: 242 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 243 - DNA, 2154 bp, Artificial Sequence
  Description of Artificial Sequence: Synthetic polynucleotide
gaagtacagcttttgcaaagcgggggtggcttggtccagcccggagggtccttgaggctctcgtgtgcggcctcagggttcgacttttcgtcgtatcccatgcactgggtccgccaggcccctggtaaagggctggagtgggtaggatccattagctcctcgggaggggcaactccgtatgcggattcagtgaaaggccgattcacaatctcgcgggataactcgaagaacaccctgtaccttcaaatgaattcactcagaccagaggacacggcagtctactattgcgctaaggacttttacactatcttgacgggaaatgcgtttgatatgtggggacagggaacctcagtgacggtcagctcagctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccgtgggctatgcggactcggtcaaggggcgcttcacaatctcaagggacaatgccaaaaactcgctctacttgcagatgaactcattgcgagctgaggacacggcgctttactactgtgcgcgggatttgggctacaatcaatggttggaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagattcccctggtaatcagtgggtctttgggggaggaactaaggtaacggtattggggtgataa

SEQ ID NO: 244 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 245 - DNA, 2166 bp, Artificial Sequence
  Description of Artificial Sequence: Synthetic polynucleotide
gaggtgcagttgctccaatccggaggtggacttgtacagccgggtgggtcgctgaggttgtcatgtgcggcgagcggattcttcttctcgaagtaccctatgcactgggtgagacaggctcccggcaaaggattggaatgggtatcatcgatttcgagcgatggcggagccacggtctatgcagactccgtcaaaggccggtttactatctcacgcgataacagcaagaatacactgtatctccagatgaactcgctgagggcggaggacacagccgtgtactactgcgccaaagacttctacacgtggctcaccgggaatgcgtttgatagctggggacaagggacttcggtcacggtgtcctcggctagcacgaaggggcctagcgtctttccgctcgccccctcgtcaaaatcaacgtcgggtggaacggccgcattgggttgtctcgtaaaggactactttccggaacccgtcaccgtatcgtggaattcaggcgccctgacttccggggtccacacctttcccgctgtcttgcagtcctcgggtttgtattcactgtcgtcagtggtgacagtaccatcatcctcactgggaactcaaacgtacatctgcaacgtgaaccacaagccgagcaacactaaggtggataagaaggtagagcccaagtcatgcgacaaaacgcatacatgcccgccatgccccgcaccagaacttttgggaggtccgtcagtgtttctctttccgcctaagcccaaagacacactgatgatttcccggacgcccgaagtcacttgtgtggtcgtcgacgtgtcccatgaagatcccgaagtaaagttcaactggtatgtcgacggtgtggaagtccacaatgcaaaaaccaagcccagggaagaacagtacaacagcacatatcgagtggtgagcgtgttgaccgtgctgcaccaagactggctcaatggaaaggagtacaaatgcaaagtgtccaacaaggcactgcctgcgcccattgagaaaacgatttcgaaagcaaagggacagccaagagaaccccaagtgtatacccttcccccgtcgcgcgaggaaatgacgaagaaccaggtatcgttgacgtgtcttgtaaagggattctatccctcggacatcgcggtcgagtgggagtccaacggacagccagagaataactacaaaaccacaccgcctgtgctggattccgacgggtcgtttttcttgtattcgaagcttacggtagacaaaagccggtggcagcagggtaatgtgttcagctgctcagtaatgcacgaggctctccataatcattacactcagaagtccctttccctttcgccgggagggggtgggggatccggcggaggtgggtcgggaggtggaggatcacaagtgcaattggtacagtcgggaggcgggcttgtgcaacccggagggtcactgcgcctttcatgtgcggcgagcggtttcacgttcgatgattatgcgatgcattgggtacggcaggcacctggcaaagggttggagtgggtagccggaatctcgtggaatagcgggagcatcggttatgcggattccgtcaaagggaggtttacaatttcgagggacaatgcgaagaacagcctgtatctccaaatgaattcgctcaggcccgaagataccgccgtctactactgcgcgagggacttgggatacaaccagtgggtggaagggtttgattactgggggcaggggactctggtaactgtctcatcggcatcgactggtggtggcgggtccggagggggaggaagcggaggaggcgggagcggaggcggtgggtccagctacgaactgactcaagatccggccgtatcggtggccctcggacaaacagtgcgaatcacctgtcagggggatagccttagatcgtactacgcttcgtggtatcagcaaaagcccggacaggcaccagtgcttgtgatctacggaaagaacaatagaccgagcggaattccggatcggttttcgggttcgacttccggaaattcggcgtcgctcacgatcaccggagctcaggcagaggatgaagcggattactattgtaattcccgcgattcgtcggggaatcattgggtgttcggtgggggtacaaaggtaactgtactcggctgataa

SEQ ID NO: 246 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 247 - DNA, 2154 bp, Artificial Sequence
  Description of Artificial Sequence: Synthetic polynucleotide
gaggtgcagttgctccaatccggaggtggacttgtacagccgggtgggtcgctgaggttgtcatgtgcggcgagcggattcttcttctcgaagtaccctatgcactgggtgagacaggctcccggcaaaggattggaatgggtatcatcgatttcgagcgatggcggagccacggtctatgcagactccgtcaaaggccggtttactatctcacgcgataacagcaagaatacactgtatctccagatgaactcgctgagggcggaggacacagccgtgtactactgcgccaaagacttctacacgtggctcaccgggaatgcgtttgatagctggggacaagggacttcggtcacggtgtcctcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtgggactcggggtccacgggctatgcggactcggtcaaggggcgcttcacaatctcaagggacaatgccaaaaactcgctctatcttcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtgaatcgcgagattcccctggtaatcagtgggtctttgggggaggaactaaggtaacggtattggggtgataa

SEQ ID NO: 248 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 249 - DNA, 2169 bp, Artificial Sequence
  Description of Artificial Sequence: Synthetic polynucleotide
gaggtgcagttgctccaatccggaggtggacttgtacagccgggtgggtcgctgaggttgtcatgtgcggcgagcggattcttcttctcgaagtaccctatgcactgggtgagacaggctcccggcaaaggattggaatgggtatcatcgatttcgagcgatggcggagccacggtctatgcagactccgtcaaaggccggtttactatctcacgcgataacagcaagaatacactgtatctccagatgaactcgctgagggcggaggacacagccgtgtactactgcgccaaagacttctacacgtggctcaccgggaatgcgtttgatagctggggacaagggacttcggtcacggtgtcctcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcgcaagtgcagctggtgcaaagcggaggtgggcttgtccaacccggaggctcacttagattgtcatgtgcggcgagcggttttacctttgacgattatgcgatgcactgggtccgccaggcaccggggaaggggctcgaatgggtagccggaatctcgtgggactcggggtccacgggctatgcggactcggtcaaggggcgcttcacaatctcaagggacaatgccaaaaactcgctctatctgcagatgaactcattgcgagctgaggacacggcgctttactactgtgcgcgggatttgggtgcctatcaatgggtagaagggtttgattactgggggcagggaactctcgtgaccgtgtccagcgcatcgacgggaggaggaggttccgggggtgggggaagcgggggtggagggtcaggaggtgggggatcgtcatacgagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctccacctcagggaactcggcctcgttgactatcacgggtgcgcaagccgaggacgaggcagactattactgtaactcgcgagattcccctggtaatcagtgggtctttgggggaggaactaaggtaacggtattggggtgataa

SEQ ID NO: 250 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 251 - DNA, 2154 bp, Artificial Sequence
  Description of Artificial Sequence: Synthetic polynucleotide
gaggtgcagttgctccaatccggaggtggacttgtacagccgggtgggtcgctgaggttgtcatgtgcggcgagcggattcttcttctcgaagtaccctatgcactgggtgagacaggctcccggcaaaggattggaatgggtatcatcgatttcgagcgatggcggagccacggtctatgcagactccgtcaaaggccggtttactatctcacgcgataacagcaagaatacactgtatctccagatgaactcgctgagggcggaggacacagccgtgtactactgcgccaaagacttctacacgtggctcaccgggaatgcgtttgatagctggggacaagggacttcggtcacggtgtcctcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaattcggggtccacgggctatgcggactcggtcaaggggcgcttcacaatctcaagggacaatgccaaaaactcgctctatttgcaaatgaactcattgcgagctgaggacacggcgctttactactgtgcgcgggatttgggctttaaccaatgggtagacgggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtaactcgcgagatacgcctggtgaccagtgggtctttgggggaggaactaaggtaacggtattggggtgataa

SEQ ID NO: 252 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 253 - DNA, 2154 bp, Artificial Sequence
  Description of Artificial Sequence: Synthetic polynucleotide
gaggtgcagttgctccaatccggaggtggacttgtacagccgggtgggtcgctgaggttgtcatgtgcggcgagcggattcttcttctcgaagtaccctatgcactgggtgagacaggctcccggcaaaggattggaatgggtatcatcgatttcgagcgatggcggagccacggtctatgcagactccgtcaaaggccggtttactatctcacgcgataacagcaagaatacactgtatctccagatgaactcgctgagggcggaggacacagccgtgtactactgcgccaaagacttctacacgtggctcaccgggaatgcgtttgatagctggggacaagggacttcggtcacggtgtcctcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccacgggctatgcggactcggtcaaggggcgcttcacaatctcaagggacaatgccaaaaactcgctctatctccagatgaactcattgcgagctgaggacacggcgctttactactgtgcgcgggatttgggttacaaccaatggcttgaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagatcaccctggtaatcagtgggtctttgggggaggaactaaggtaacggtattggggtgataa

SEQ ID NO: 254 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 255 - DNA, 2154 bp, Artificial Sequence
  Description of Artificial Sequence: Synthetic polynucleotide
gaggtgcagttgctccaatccggaggtggacttgtacagccgggtgggtcgctgaggttgtcatgtgcggcgagcggattcttcttctcgaagtaccctatgcactgggtgagacaggctcccggcaaaggattggaatgggtatcatcgatttcgagcgatggcggagccacggtctatgcagactccgtcaaaggccggtttactatctcacgcgataacagcaagaatacactgtatctccagatgaactcgctgagggcggaggacacagccgtgtactactgcgccaaagacttctacacgtggctcaccgggaatgcgtttgatagctggggacaagggacttcggtcacggtgtcctcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccaggtaaaggaggtggcgggagcgggggagggggatccggtggcggagggtcggaagtgcagctggtggagagcggaggtgggcttgtccaaccgggcaggtcacttagattgtcatgtgcggcgagcggttttacctttgacgattatgcgatgcactgggtccgccaggcaccggggaaggggctcgaatgggtatcaggaatctcgtggaactcggggtccgtgggctatgcggactcggtcaaggggcgcttcacaatctcaagggacaatgccaaaaactcgctctacttgcagatgaactcattgcgagctgaggacacggcgctttactactgtgcgcgggatttgggctacaatcaatggttggaagggtttgattactgggggcagggaactctcgtgaccgtgtccagcgcatcgacgggaggaggaggttccgggggtgggggaagcgggggtggagggtcatcgtcagagctgacgcaagatcccgcggtatccgtcgcccttgggcagaccgtcaggattacgtgccagggagactcacttagaagctactacgcttcctggtatcagcaaaagccgggacaggcacccgtgttggtgatctacgggaagaataaccggcccagcgggattcctgaccgcttttcgggctcctcatcggggaacacagcctcgttgactatcacgggtgcgcaagccgaggacgaggcagactattactgtatgtcgcgagattcccctggtaatcagtgggtctttgggggaggaactaaggtaacggtattggggtgataa

SEQ ID NO: 256 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 257 - DNA, 648 bp, Artificial Sequence
  Description of Artificial Sequence: Synthetic polynucleotide
tcaagcgaattgacccaagaccccgcagtctccgtggcgcttgggcaaactgtgagaatcacgtgtcaaggagacagccttagaagctactatgcctcgtggtatcagcagaagccaggtcaggccccagtcctcgtgatctacgggaagaacaaccgcccctcgggtattcccgaccgcttttcgggatcgtcctccggaaatacggcttccctgacgatcaccggagcccaagcggaagatgaggcggattactattgcgaatcacgggacagcccgggtaaccagtgggtattcgggggaggcactaaagtaacagtgctcggccagcctaaagcggcaccgtcggtgactctctttcccccgtcatcggaagagcttcaggcgaataaggcgacactggtatgcttggtcagcgatttctacccgggagccgtaacggtcgcgtggaaagcggacgggtcgcccgtgaaagtcggggtcgagacaacgaaaccctcaaaacagtcgaataacaagtacgcggcatcatcatatctctcattgacccctgaacagtggaagagccataggtcgtactcgtgtcgagtcacacacgagggatccaccgtagaaaagacagtggctcctgccgagtgttcctgataa

SEQ ID NO: 258 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 259 - DNA, 648 bp, Artificial Sequence
  Description of Artificial Sequence: Synthetic polynucleotide
tcaagcgaattgacccaagaccccgcagtctccgtggcgcttgggcaaactgtgagaatcacgtgtcaaggagacagccttagaagctactatgcctcgtggtatcagcagaagccaggtcaggccccagtcctcgtgatctacgggaagaacaaccgcccctcgggtattcccgaccgcttttcgggatcgtcctccggaaatacggcttccctgacgatcaccggagcccaagcggaagatgaggcggattactattgcaactcacgggacacaccgggtgaccagtgggtattcgggggaggcactaaagtaacagtgctcggccagcctaaagcggcaccgtcggtgactctctttcccccgtcatcggaagagcttcaggcgaataaggcgacactggtatgcttggtcagcgatttctacccgggagccgtaacggtcgcgtggaaagcggacgggtcgcccgtgaaagtcggggtcgagacaacgaaaccctcaaaacagtcgaataacaagtacgcggcatcatcatatctctcattgacccctgaacagtggaagagccataggtcgtactcgtgtcgagtcacacacgagggatccaccgtagaaaagacagtggctcctgccgagtgttcctgataa

SEQ ID NO: 260 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 261 - DNA, 648 bp, Artificial Sequence
  Description of Artificial Sequence: Synthetic polynucleotide
tcaagcgaattgacccaagaccccgcagtctccgtggcgcttgggcaaactgtgagaatcacgtgtcaaggagacagccttagaagctactatgcctcgtggtatcagcagaagccaggtcaggccccagtcctcgtgatctacgggaagaacaaccgcccctcgggtattcccgaccgcttttcgggatcgtcctccggaaatacggcttccctgacgatcaccggagcccaagcggaagatgaggcggattactattgcaactcacgggacacgccgggtaacaagtgggtattcgggggaggcactaaagtaacagtgattggccagcctaaagcggcaccgtcggtgactctctttcccccgtcatcggaagagcttcaggcgaataaggcgacactggtatgcttggtcagcgatttctacccgggagccgtaacggtcgcgtggaaagcggacgggtcgcccgtgaaagtcggggtcgagacaacgaaaccctcaaaacagtcgaataacaagtacgcggcatcatcatatctctcattgacccctgaacagtggaagagccataggtcgtactcgtgtcgagtcacacacgagggatccaccgtagaaaagacagtggctcctgccgagtgttcctgataa

SEQ ID NO: 262 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVIGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 263 - DNA, 648 bp, Artificial Sequence
  Description of Artificial Sequence: Synthetic polynucleotide
tcaagcgaattgacccaagaccccgcagtctccgtggcgcttgggcaaactgtgagaatcacgtgtcaaggagacagccttagaagctactatgcctcgtggtatcagcagaagccaggtcaggccccagtcctcgtgatctacgggaagaacaaccgcccctcgggtattcccgaccgcttttcgggatcgtcctccggaaatacggcttccctgacgatcaccggagcccaagcggaagatgaggcggattactattgcaattcacgggacgtgccgggtgaccagtgggtattcgggggaggcactaaagtaacagtgctcggccagcctaaagcggcaccgtcggtgactctctttcccccgtcatcggaagagcttcaggcgaataaggcgacactggtatgcttggtcagcgatttctacccgggagccgtaacggtcgcgtggaaagcggacgggtcgcccgtgaaagtcggggtcgagacaacgaaaccctcaaaacagtcgaataacaagtacgcggcatcatcatatctctcattgacccctgaacagtggaagagccataggtcgtactcgtgtcgagtcacacacgagggatccaccgtagaaaagacagtggctcctgccgagtgttcctgataa

SEQ ID NO: 264 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDVPGDQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 265 - DNA, 648 bp, Artificial Sequence
  Description of Artificial Sequence: Synthetic polynucleotide
tcaagcgaattgacccaagaccccgcagtctccgtggcgcttgggcaaactgtgagaatcacgtgtcaaggagacagccttagaagctactatgcctcgtggtatcagcagaagccaggtcaggccccagtcctcgtgatctacgggaagaacaaccgcccctcgggtattcccgaccgcttttcgggatcgtcctccggaaatacggcttccctgacgatcaccggagcccaagcggaagatgaggcggattactattgcaattcacgggactggccgggtaaccagtgggtattcgggggaggcactaaagtaacagtgctcggccagcctaaagcggcaccgtcggtgactctctttcccccgtcatcggaagagcttcaggcgaataaggcgacactggtatgcttggtcagcgatttctacccgggagccgtaacggtcgcgtggaaagcggacgggtcgcccgtgaaagtcggggtcgagacaacgaaaccctcaaaacagtcgaataacaagtacgcggcatcatcatatctctcattgacccctgaacagtggaagagccataggtcgtactcgtgtcgagtcacacacgagggatccaccgtagaaaagacagtggctcctgccgagtgttcctgataa

SEQ ID NO: 266 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDWPGNQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 267 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcaacgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggtcgagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccgggtggtgggggaggtagcgggggtggagggtccggaggtgggggaagcgaagtgcaacttctccagtccggagggggcctcgtacaacccggagggtcattgaggctgtcatgtgcagcgtcggggttcatgttttcacggtatcccatgcactgggtgcgacaggcgccagggaaaggcctcgaatgggtaggatccatttcgggatcgggcggtgcaactccctacgccgacagcgtgaagggaaggtttaccatctcacgcgataactcgaaaaacacgctgtacttgcagatgaattcgctgagggcggaagatacggcggtctactattgcgctaaggacttctaccagattttgacaggaaatgcctttgattactggggtcagggcacgacagtaacagtgtcatcggcgtcgacagggggagggggctcgggaggaggcgggtcaggtggagggggatcgggtggcggaggatccgatattcagatgacccagtccccgtccagccttagcgcgagcctgggcgaccgggtcactatcacgtgtcgggcatcccagggtatctcgtcatatctggcgtggtatcaacagaagcctggtaaagccccgaagttgcttatctacgccaagtcaaccctccagtcgggggtccccagcagattttcggggtcgggaagcggaacggacttcacgctcaccatctcaagcctccagccagaggattcagctacgtactattgccaacagtactggacgttccctcttacattcgggggtgggacaaaagtggagattaagagaacttgataa

SEQ ID NO: 268 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 269 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcaacgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggtcgagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggtggaggagggggttccggtggtggtgggtcgggaggaggaggctcggaggtgcagcttctgcagtcgggtggagggctcgtgcagccaggcggctcacttcgcctttcatgcgcggcatcaggctttttcttcagcaagtatcccatgcattgggtcagacaagcaccggggaagggattggaatgggtcagctcaatttcgtcggatgggggagccacagtatacgcggactccgtaaaagggcgattcacaatttcccgcgacaattccaaaaacacgctgtatctccaaatgaactcgcttagggctgaagataccgccgtctactactgtgcgaaggacttttacacttggttgactggtaatgcgttcgattcatgggggcagggcacaagcgtgacagtatcgtccgcctcaacgggaggtggaggtagcggaggcggagggtcgggcggtggtggaagcgggggaggagggagcgacatccagctgacgcagtcaccctcatcgctgtccgcgtcattgggagatcgggtgacgattacttgcagagcatcgcagggaatctcctcgtacctcgcctggtatcaacaaaaacccgggaaagcaccgaaacttctcatctacgcgagatcgacgcgccagagcggagtacctagcaggttctccgggtcgggaagcgggacagagtttaccctcacaatctcgtcattgcagccggaggactcggctacgtactattgtcagcagtattggacctggcctttgacttttggcggagggacgaaggtggagatcaagcggacatgataa

SEQ ID NO: 270 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 271 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcaacgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggtcgagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 272 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 273 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtggaactcggggtcaacgggctatgccgattccgtaaagggtaggttcaccatctcacgcgacaatgcgaagaattcgttgtaccttcaaatgaattcgcttagggcagaagatacggccttgtactattgcgcaagggaccttgggttcaaccagtgggtcgacggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccgggtggtgggggaggtagcgggggtggagggtccggaggtgggggaagcgaagtgcaacttctccagtccggagggggcctcgtacaacccggagggtcattgaggctgtcatgtgcagcgtcggggttcatgttttcacggtatcccatgcactgggtgcgacaggcgccagggaaaggcctcgaatgggtaggatccatttcgggatcgggcggtgcaactccctacgccgacagcgtgaagggaaggtttaccatctcacgcgataactcgaaaaacacgctgtacttgcagatgaattcgctgagggcggaagatacggcggtctactattgcgctaaggacttctaccagattttgacaggaaatgcctttgattactggggtcagggcacgacagtaacagtgtcatcggcgtcgacagggggagggggctcgggaggaggcgggtcaggtggagggggatcgggtggcggaggatccgatattcagatgacccagtccccgtccagccttagcgcgagcctgggcgaccgggtcactatcacgtgtcgggcatcccagggtatctcgtcatatctggcgtggtatcaacagaagcctggtaaagccccgaagttgcttatctacgccaagtcaaccctccagtcgggggtccccagcagattttcggggtcgggaagcggaacggacttcacgctcaccatctcaagcctccagccagaggattcagctacgtactattgccaacagtactggacgttccctcttacattcgggggtgggacaaaagtggagattaagagaacttgataa

SEQ ID NO: 274 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 275 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtggaactcggggtcaacgggctatgccgattccgtaaagggtaggttcaccatctcacgcgacaatgcgaagaattcgttgtaccttcaaatgaattcgcttagggcagaagatacggccttgtactattgcgcaagggaccttgggttcaaccagtgggtcgacggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggtggaggagggggttccggtggtggtgggtcgggaggaggaggctcggaggtgcagcttctgcagtcgggtggagggctcgtgcagccaggcggctcacttcgcctttcatgcgcggcatcaggctttttcttcagcaagtatcccatgcattgggtcagacaagcaccggggaagggattggaatgggtcagctcaatttcgtcggatgggggagccacagtatacgcggactccgtaaaagggcgattcacaatttcccgcgacaattccaaaaacacgctgtatctccaaatgaactcgcttagggctgaagataccgccgtctactactgtgcgaaggacttttacacttggttgactggtaatgcgttcgattcatgggggcagggcacaagcgtgacagtatcgtccgcctcaacgggaggtggaggtagcggaggcggagggtcgggcggtggtggaagcgggggaggagggagcgacatccagctgacgcagtcaccctcatcgctgtccgcgtcattgggagatcgggtgacgattacttgcagagcatcgcagggaatctcctcgtacctcgcctggtatcaacaaaaacccgggaaagcaccgaaacttctcatctacgcgagatcgacgcgccagagcggagtacctagcaggttctccgggtcgggaagcgggacagagtttaccctcacaatctcgtcattgcagccggaggactcggctacgtactattgtcagcagtattggacctggcctttgacttttggcggagggacgaaggtggagatcaagcggacatgataa

SEQ ID NO: 276 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 277 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtggaactcggggtcaacgggctatgccgattccgtaaagggtaggttcaccatctcacgcgacaatgcgaagaattcgttgtaccttcaaatgaattcgcttagggcagaagatacggccttgtactattgcgcaagggaccttgggttcaaccagtgggtcgacggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 278 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 279 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtacctccaaatgaattcgcttagggcagaagatacggccttgtactattgcgcaagggaccttgggtacaaccagtggtgggaaggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccgggtggtgggggaggtagcgggggtggagggtccggaggtgggggaagcgaagtgcaacttctccagtccggagggggcctcgtacaacccggagggtcattgaggctgtcatgtgcagcgtcggggttcatgttttcacggtatcccatgcactgggtgcgacaggcgccagggaaaggcctcgaatgggtaggatccatttcgggatcgggcggtgcaactccctacgccgacagcgtgaagggaaggtttaccatctcacgcgataactcgaaaaacacgctgtacttgcagatgaattcgctgagggcggaagatacggcggtctactattgcgctaaggacttctaccagattttgacaggaaatgcctttgattactggggtcagggcacgacagtaacagtgtcatcggcgtcgacagggggagggggctcgggaggaggcgggtcaggtggagggggatcgggtggcggaggatccgatattcagatgacccagtccccgtccagccttagcgcgagcctgggcgaccgggtcactatcacgtgtcgggcatcccagggtatctcgtcatatctggcgtggtatcaacagaagcctggtaaagccccgaagttgcttatctacgccaagtcaaccctccagtcgggggtccccagcagattttcggggtcgggaagcggaacggacttcacgctcaccatctcaagcctccagccagaggattcagctacgtactattgccaacagtactggacgttccctcttacattcgggggtgggacaaaagtggagattaagagaacttgataa

SEQ ID NO: 280 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 281 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtacctccaaatgaattcgcttagggcagaagatacggccttgtactattgcgcaagggaccttgggtacaaccagtggtgggaaggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggtggaggagggggttccggtggtggtgggtcgggaggaggaggctcggaggtgcagcttctgcagtcgggtggagggctcgtgcagccaggcggctcacttcgcctttcatgcgcggcatcaggctttttcttcagcaagtatcccatgcattgggtcagacaagcaccggggaagggattggaatgggtcagctcaatttcgtcggatgggggagccacagtatacgcggactccgtaaaagggcgattcacaatttcccgcgacaattccaaaaacacgctgtatctccaaatgaactcgcttagggctgaagataccgccgtctactactgtgcgaaggacttttacacttggttgactggtaatgcgttcgattcatgggggcagggcacaagcgtgacagtatcgtccgcctcaacgggaggtggaggtagcggaggcggagggtcgggcggtggtggaagcgggggaggagggagcgacatccagctgacgcagtcaccctcatcgctgtccgcgtcattgggagatcgggtgacgattacttgcagagcatcgcagggaatctcctcgtacctcgcctggtatcaacaaaaacccgggaaagcaccgaaacttctcatctacgcgagatcgacgcgccagagcggagtacctagcaggttctccgggtcgggaagcgggacagagtttaccctcacaatctcgtcattgcagccggaggactcggctacgtactattgtcagcagtattggacctggcctttgacttttggcggagggacgaaggtggagatcaagcggacatgataa

SEQ ID NO: 282 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 283 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtacctccaaatgaattcgcttagggcagaagatacggccttgtactattgcgcaagggaccttgggtacaaccagtggtgggaaggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 284 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 285 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtggaattcggggtcaagaggctatgccgattccgtaaagggtaggttcaccatctcacgcgacaatgcgaagaattcgttgtacttgcagatgaattcgcttagggcagaagatacggccttgtactattgcgcaagggaccttgggttcaatcagtgggaagagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccgggtggtgggggaggtagcgggggtggagggtccggaggtgggggaagcgaagtgcaacttctccagtccggagggggcctcgtacaacccggagggtcattgaggctgtcatgtgcagcgtcggggttcatgttttcacggtatcccatgcactgggtgcgacaggcgccagggaaaggcctcgaatgggtaggatccatttcgggatcgggcggtgcaactccctacgccgacagcgtgaagggaaggtttaccatctcacgcgataactcgaaaaacacgctgtacttgcagatgaattcgctgagggcggaagatacggcggtctactattgcgctaaggacttctaccagattttgacaggaaatgcctttgattactggggtcagggcacgacagtaacagtgtcatcggcgtcgacagggggagggggctcgggaggaggcgggtcaggtggagggggatcgggtggcggaggatccgatattcagatgacccagtccccgtccagccttagcgcgagcctgggcgaccgggtcactatcacgtgtcgggcatcccagggtatctcgtcatatctggcgtggtatcaacagaagcctggtaaagccccgaagttgcttatctacgccaagtcaaccctccagtcgggggtccccagcagattttcggggtcgggaagcggaacggacttcacgctcaccatctcaagcctccagccagaggattcagctacgtactattgccaacagtactggacgttccctcttacattcgggggtgggacaaaagtggagattaagagaacttgataa

SEQ ID NO: 286 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 287 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtggaattcggggtcaagaggctatgccgattccgtaaagggtaggttcaccatctcacgcgacaatgcgaagaattcgttgtacttgcagatgaattcgcttagggcagaagatacggccttgtactattgcgcaagggaccttgggttcaatcagtgggaagagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggtggaggagggggttccggtggtggtgggtcgggaggaggaggctcggaggtgcagcttctgcagtcgggtggagggctcgtgcagccaggcggctcacttcgcctttcatgcgcggcatcaggctttttcttcagcaagtatcccatgcattgggtcagacaagcaccggggaagggattggaatgggtcagctcaatttcgtcggatgggggagccacagtatacgcggactccgtaaaagggcgattcacaatttcccgcgacaattccaaaaacacgctgtatctccaaatgaactcgcttagggctgaagataccgccgtctactactgtgcgaaggacttttacacttggttgactggtaatgcgttcgattcatgggggcagggcacaagcgtgacagtatcgtccgcctcaacgggaggtggaggtagcggaggcggagggtcgggcggtggtggaagcgggggaggagggagcgacatccagctgacgcagtcaccctcatcgctgtccgcgtcattgggagatcgggtgacgattacttgcagagcatcgcagggaatctcctcgtacctcgcctggtatcaacaaaaacccgggaaagcaccgaaacttctcatctacgcgagatcgacgcgccagagcggagtacctagcaggttctccgggtcgggaagcgggacagagtttaccctcacaatctcgtcattgcagccggaggactcggctacgtactattgtcagcagtattggacctggcctttgacttttggcggagggacgaaggtggagatcaagcggacatgataa

SEQ ID NO: 288 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 289 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtggaattcggggtcaagaggctatgccgattccgtaaagggtaggttcaccatctcacgcgacaatgcgaagaattcgttgtacttgcagatgaattcgcttagggcagaagatacggccttgtactattgcgcaagggaccttgggttcaatcagtgggaagagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 290 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 291 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggaggagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgccgggtggtgggggaggtagcgggggtggagggtccggaggtgggggaagcgaagtgcaacttctccagtccggagggggcctcgtacaacccggagggtcattgaggctgtcatgtgcagcgtcggggttcatgttttcacggtatcccatgcactgggtgcgacaggcgccagggaaaggcctcgaatgggtaggatccatttcgggatcgggcggtgcaactccctacgccgacagcgtgaagggaaggtttaccatctcacgcgataactcgaaaaacacgctgtacttgcagatgaattcgctgagggcggaagatacggcggtctactattgcgctaaggacttctaccagattttgacaggaaatgcctttgattactggggtcagggcacgacagtaacagtgtcatcggcgtcgacagggggagggggctcgggaggaggcgggtcaggtggagggggatcgggtggcggaggatccgatattcagatgacccagtccccgtccagccttagcgcgagcctgggcgaccgggtcactatcacgtgtcgggcatcccagggtatctcgtcatatctggcgtggtatcaacagaagcctggtaaagccccgaagttgcttatctacgccaagtcaaccctccagtcgggggtccccagcagattttcggggtcgggaagcggaacggacttcacgctcaccatctcaagcctccagccagaggattcagctacgtactattgccaacagtactggacgttccctcttacattcgggggtgggacaaaagtggagattaagagaacttgataa

SEQ ID NO: 292 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 293 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggaggagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggtggaggagggggttccggtggtggtgggtcgggaggaggaggctcggaggtgcagcttctgcagtcgggtggagggctcgtgcagccaggcggctcacttcgcctttcatgcgcggcatcaggctttttcttcagcaagtatcccatgcattgggtcagacaagcaccggggaagggattggaatgggtcagctcaatttcgtcggatgggggagccacagtatacgcggactccgtaaaagggcgattcacaatttcccgcgacaattccaaaaacacgctgtatctccaaatgaactcgcttagggctgaagataccgccgtctactactgtgcgaaggacttttacacttggttgactggtaatgcgttcgattcatgggggcagggcacaagcgtgacagtatcgtccgcctcaacgggaggtggaggtagcggaggcggagggtcgggcggtggtggaagcgggggaggagggagcgacatccagctgacgcagtcaccctcatcgctgtccgcgtcattgggagatcgggtgacgattacttgcagagcatcgcagggaatctcctcgtacctcgcctggtatcaacaaaaacccgggaaagcaccgaaacttctcatctacgcgagatcgacgcgccagagcggagtacctagcaggttctccgggtcgggaagcgggacagagtttaccctcacaatctcgtcattgcagccggaggactcggctacgtactattgtcagcagtattggacctggcctttgacttttggcggagggacgaaggtggagatcaagcggacatgataa

SEQ ID NO: 294 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 295 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggaggagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 296 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 297 - DNA, 702 bp, Artificial Sequence
  Description of Artificial Sequence: Synthetic polynucleotide
atgggcacgcctgcgcagttgctcttcctgttgctcctttggctgcccgacacgacgggggacattcagatgactcagagcccttcgtcccttagcgcatcaacaggggatcgagtaacgattacttgcagagcctcacaaggtatttcatcgtatctcgcatggtaccaacaaaagccgggtaaagctccgaaactcttgatctacgccgcgagcactctgcagtccggagtgccctcacgcttctcgggatcggggtcagggactgacttcacgctgaccatctccagcttgcagccagaggattttgcaacatactattgccagcagtacttcacgttccctcttacatttggaggtggaacaaaagtcgaaatcaaaaggacagtggctgcgccctcggtctttatctttccgccgtcggatgagcaactcaagtcggggactgcctcggtggtatgtttgctcaacaatttctatccccgggaagcgaaggtacagtggaaggtcgataatgccctccagagcggcaactcgcaagagtcagtcacagaacaggattccaaggactcgacgtattcactttcctcgacattgaccttgagcaaggccgactacgagaagcacaaagtgtatgcgtgtgaggtcacgcatcagggcctgtcatcgccagtgaccaagtcgtttaacagaggcgaatgc

SEQ ID NO: 298 - protein, 234 aa, Artificial Sequence
  Description of Artificial Sequence: Synthetic polypeptide
MGTPAQLLFLLLLWLPDTTGDIQMTQSPSSLSASTGDRVTITCRASQGISSYLAWYQQKPGKAPKLLIYAASTLQSGVPSRFSGSGSGTDFTLTISSLQPEDFATYYCQQYFTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - DNA, 2217 bp, Artificial Sequence
  Description of Artificial Sequence: Synthetic polynucleotide
atgggcttcggtttgtcctggctgtttctggtcgctattcttaaaggagtgcagtgcgaggtgcagctcctccaaagcggagggggtttggtccagcccggtggctcgttgcgcctctcatgtgccgcgtcggggtttacattcagcgtctatccgatgcactgggtacgacaggcgccagggaaaggactggagtgggtgtcatcgatcagcagctccggaggtgctacaagatatgccgactcggtgaaaggccgctttacgatcagccgcgataacagcaagaatacgttgtacctccaaatgaactcgctgcgagccgaggacactgcggtgtactattgcgcgaaggatttctatgacatccttactggtaatgcgtttgatatctggggccaggggacaacggtcaccgtgagctcggccagcacgaaggggcctagcgtctttccgctcgccccctcgtcaaaatcaacgtcgggtggaacggccgcattgggttgtctcgtaaaggactactttccggaacccgtcaccgtatcgtggaattcaggcgccctgacttccggggtccacacctttcccgctgtcttgcagtcctcgggtttgtattcactgtcgtcagtggtgacagtaccatcatcctcactgggaactcaaacgtacatctgcaacgtgaaccacaagccgagcaacactaaggtggataagaaggtagagcccaagtcatgcgacaaaacgcatacatgcccgccatgccccgcaccagaacttttgggaggtccgtcagtgtttctctttccgcctaagcccaaagacacactgatgatttcccggacgcccgaagtcacttgtgtggtcgtcgacgtgtcccatgaagatcccgaagtaaagttcaactggtatgtcgacggtgtggaagtccacaatgcaaaaaccaagcccagggaagaacagtacaacagcacatatcgagtggtgagcgtgttgaccgtgctgcaccaagactggctcaatggaaaggagtacaaatgcaaagtgtccaacaaggcactgcctgcgcccattgagaaaacgatttcgaaagcaaagggacagccaagagaaccccaagtgtatacccttcccccgtcgcgcgaggaaatgacgaagaaccaggtatcgttgacgtgtcttgtaaagggattctatccctcggacatcgcggtcgagtgggagtccaacggacagccagagaataactacaaaaccacaccgcctgtgctggattccgacgggtcgtttttcttgtattcgaagcttacggtagacaaaagccggtggcagcagggtaatgtgttcagctgctcagtaatgcacgaggctctccataatcattacactcagaagtccctttccctttcgccgggagggggtgggggatccggcggaggtgggtcgggaggtggaggatcacaagtgcaattggtacagtcgggaggcgggcttgtgcaacccggagggtcactgcgcctttcatgtgcggcgagcggtttcacgttcgatgattatgcgatgcattgggtacggcaggcacctggcaaagggttggagtgggtagccggaatctcgtggaatagcgggagcatcggttatgcggattccgtcaaagggaggtttacaatttcgagggacaatgcgaagaacagcctgtatctccaaatgaattcgctcaggcccgaagataccgccgtctactactgcgcgagggacttgggatacaaccagtgggtggaagggtttgattactgggggcaggggactctggtaactgtctcatcggcatcgactggtggtggcgggtccggagggggaggaagcggaggaggcgggagcggaggcggtgggtccagctacgaactgactcaagatccggccgtatcggtggccctcggacaaacagtgcgaatcacctgtcagggggatagccttagatcgtactacgcttcgtggtatcagcaaaagcccggacaggcaccagtgcttgtgatctacggaaagaacaatagaccgagcggaattccggatcggttttcgggttcgacttccggaaattcggcgtcgctcacgatcaccggagctcaggcagaggatgaagcggattactattgtaattcccgcgattcgtcggggaatcattgggtgttcggtgggggtacaaaggtaactgtactcggc

SEQ ID NO: 300 - protein, 739 aa, Artificial Sequence
  Description of Artificial Sequence: Synthetic polypeptide
MGFGLSWLFLVAILKGVQCEVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 301 - protein, 13 aa, Artificial Sequence
  Description of Artificial Sequence: Synthetic peptide
SLSLSPGKGGGGS

SEQ ID NO: 302 - protein, 10 aa, Artificial Sequence
  Description of Artificial Sequence: Synthetic peptide
  MOD_RES (3)..(3): Phe, Asp, Asn, Thr, Leu, Val, Met, Glu, Arg, Ser, Ala, Trp or Pro
  MOD_RES (6)..(6): Lys, Ser, Arg, Val, His, Glu, Ile, Asn, Asp, Ala or Thr
GFXFSXYPMH

SEQ ID NO: 303 - protein, 16 aa, Artificial Sequence
  Description of Artificial Sequence: Synthetic peptide
  MOD_RES (3)..(3): Ser, Gly, Ala or Pro
  MOD_RES (4)..(4): Asp, Ser, Trp, Gly or Leu
  MOD_RES (9)..(9): Val, Pro, Arg, Ile or Ala
ISXXGGATXYADSVKG

SEQ ID NO: 304 - protein, 13 aa, Artificial Sequence
  Description of Artificial Sequence: Synthetic peptide
  MOD_RES (4)..(4): Thr, Gln, Asp, Tyr, Asn, Arg, Trp, Phe, His, Met or Lys
  MOD_RES (5)..(5): Trp, Ile, Met or Leu
  MOD_RES (13)..(13): Ser, Met, Tyr, Ile, Lys, Glu, Val, Ala, Arg, Thr or Asn
DFYXXLTGNAFDX

SEQ ID NO: 305 - protein, 11 aa, Artificial Sequence
  Description of Artificial Sequence: Synthetic peptide
RASQGISSYLA

SEQ ID NO: 306 - protein, 7 aa, Artificial Sequence
  Description of Artificial Sequence: Synthetic peptide
  MOD_RES (2)..(2): Arg, Ser, Lys, Ala, Gly, Gln, Thr, Asn, Pro or Asp
  MOD_RES (5)..(5): Arg, Leu, Cys, Thr, Pro, Gly, Ser, Lys, Glu, Gln, His Ala, Tyr, Ile
AXSTXQS

SEQ ID NO: 307 - protein, 9 aa, Artificial Sequence
  Description of Artificial Sequence: Synthetic peptide
  MOD_RES (4)..(4): Trp or Phe
  MOD_RES (5)..(5): Thr, Ala, Arg, Met, Phe, Ser, Asn, Trp, Gln, Leu or Val
  MOD_RES (6)..(6): Trp or Phe
QQYXXXPLT

SEQ ID NO: 308 - protein, 9 aa, Artificial Sequence
  Description of Artificial Sequence: Synthetic peptide
  MOD_RES (5)..(5): Thr, Ala, Arg, Met, Phe, Ser, Asn, Trp, Gln, Leu or Val
  MOD_RES (6)..(6): Trp or Phe
QQYWXXPLT

SEQ ID NO: 309 - protein, 10 aa, Artificial Sequence
  Description of Artificial Sequence: Synthetic peptide
GFTFDDYAMH

SEQ ID NO: 310 - protein, 16 aa, Artificial Sequence
  Description of Artificial Sequence: Synthetic peptide
  MOD_RES (4)..(4): Asp or Asn
  MOD_RES (8)..(8): Val, Arg, Thr, Ile, Met, Ser, Asn or Leu
ISWXSGSXGYADSVKG

SEQ ID NO: 311 - protein, 13 aa, Artificial Sequence
  Description of Artificial Sequence: Synthetic peptide
  MOD_RES (4)..(4): Ala, Phe or Tyr
  MOD_RES (5)..(5): Tyr, Asn, Lys, Phe, Met or Ser
  MOD_RES (8)..(8): Glu, Val, Trp, Leu, Gln or Asn
  MOD_RES (9)..(9): Glu or Asp
DLGXXQWXXGFDY

SEQ ID NO: 312 - protein, 11 aa, Artificial Sequence
  Description of Artificial Sequence: Synthetic peptide
QGDSLRSYYAS

SEQ ID NO: 313 - protein, 7 aa, Artificial Sequence
  Description of Artificial Sequence: Synthetic peptide
GKNNRPS

SEQ ID NO: 314 - protein, 11 aa, Artificial Sequence
  Description of Artificial Sequence: Synthetic peptide
  MOD_RES (1)..(1): Asn, Glu or Met
  MOD_RES (5)..(5): Trp, Val, Thr, Ser, His, Tyr, Asn or Ala
  MOD_RES (6)..(6): Ser or Pro
  MOD_RES (8)..(8): Asn or Asp
  MOD_RES (9)..(9): Gln, Lys, His, Ser, Val, Arg, Thr or Asn
XSRDXXGXXWV

SEQ ID NO: 315 - protein, 11 aa, Artificial Sequence
  Description of Artificial Sequence: Synthetic peptide
  MOD_RES (1)..(1): Asn, Glu or Met
  MOD_RES (5)..(5): Trp, Val, Thr, Ser, His, Tyr, Asn or Ala
  MOD_RES (8)..(8): Asn or Asp
  MOD_RES (9)..(9): Gln, Lys, His, Ser, Val, Arg, Thr or Asn
XSRDXPGXXWV

SEQ ID NO: 316 - protein, 708 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGGGGSGGGGSLQEVQLLESGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTMVTVSSASTGGGGSGGGGSGGGGSDIQMTQSPSSFSASTGDRVTITCRASQGISSYLAWYQQKPGKAPKLLIYAASTLQSGVPSRFSGSGSGTDFTLTISSLQPEDSATYYCQQYFTFPLTFGGGTKVEIK

SEQ ID NO: 317 - protein, 216 aa, Artificial Sequence
  Description of Artificial Sequence: Synthetic polypeptide
QSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 318 - protein, 712 aa, Artificial Sequence [sequence omitted]

SEQ ID NO: 319 - protein, 711 aa, Artificial Sequence
  Description of Artificial Sequence: Synthetic polypeptide
EVQLLESGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGGGGSGGGGSLQEVQLLESGGGLVQPGGSLRLSCAASGFTFSVYDMYWVRQAPGKGLEWVSYIYSSGGDTDYADSVKGRFTISRDNSKNTLYLQMNSLRAEDTATYYCARASTNSIYDAMDVWGQGTTVTVSSASTGGGGSGGGGSGGGGSDIQMTQSPSSVSASVGDRVTITCRASQDITNWLAWYQQKPGKAPTLLIYDASTLQSGVPSRFSGSGSGTDFTLTISSLQPEDFATYFCQQANGFPLTFGGGTKVEIK

SEQ ID NO: 320 - protein, 214 aa, Artificial Sequence
  Description of Artificial Sequence: Synthetic polypeptide
DIQMTQSPSSFSASTGDRVTITCRASQGISSYLAWYQQKPGKAPKLLIYAASTLQSGVPSRFSGSGSGTDFTLTISSLQPEDSATYYCQQYFTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 223 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 322 - protein, 214 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323 - protein, 257 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTGGGGSGGGGSGGGGSGGGGSDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRT

SEQ ID NO: 324 - protein, 228 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 325 - protein, 214 aa, Artificial Sequence
  Description of Artificial Sequence: Synthetic polypeptide
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 326 - protein, 262 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTGGGGSGGGGSGGGGSGGGGSSSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG

SEQ ID NO: 327 - protein, 217 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 328 - protein, 219 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 256 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTGGGGSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPLTFGQGTKVEIKRT

SEQ ID NO: 330 - protein, 222 aa, Artificial Sequence
  Description of Artificial Sequence: Synthetic polypeptide
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 331 - protein, 219 aa, Artificial Sequence
  Description of Artificial Sequence: Synthetic polypeptide
DIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 261 aa, Artificial Sequence
  Description of Artificial Sequence: Synthetic polypeptide
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSSASTGGGGSGGGGSGGGGSGGGGSDIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIKRT

SEQ ID NO: 333 - protein, 218 aa, Artificial Sequence
  Description of Artificial Sequence: Synthetic polypeptide
EVQLLESGGGLVQPGGSLRLSCAASGFTFSIYRMQWVRQAPGKGLEWVSGISPSGGTTWYADSVKGRFTISRDNSKNTLYLQMNSLRAEDTAVYYCARWSGGSGYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 334 - protein, 214 aa, Artificial Sequence
  Description of Artificial Sequence: Synthetic polypeptide
DIQMTQSPLSLSASVGDRVTITCQASRDIRNYLNWYQQKPGKAPKLLIYDASSLQTGVPSRFGGSGSGTDFSFTIGSLQPEDIATYYCQQFDSLPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 252 aa, Artificial Sequence
  Description of Artificial Sequence: Synthetic polypeptide
EVQLLESGGGLVQPGGSLRLSCAASGFTFSIYRMQWVRQAPGKGLEWVSGISPSGGTTWYADSVKGRFTISRDNSKNTLYLQMNSLRAEDTAVYYCARWSGGSGYAFDIWGQGTMVTVSSASTGGGGSGGGGSGGGGSGGGGSDIQMTQSPLSLSASVGDRVTITCQASRDIRNYLNWYQQKPGKAPKLLIYDASSLQTGVPSRFGGSGSGTDFSFTIGSLQPEDIATYYCQQFDSLPHTFGQGTKLEIKRT

SEQ ID NO: 336 - protein, 215 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 337 - protein, 220 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 255 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTGGGGSGGGGSGGGGSGGGGSDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRT

SEQ ID NO: 339 - protein, 216 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 340 - protein, 217 aa, Artificial Sequence
  Description of Artificial Sequence: Synthetic polypeptide
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 341 - protein, 253 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTGGGGSGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLG

SEQ ID NO: 342 - protein, 216 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 343 - protein, 216 aa, Artificial Sequence
  Description of Artificial Sequence: Synthetic polypeptide
QSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 344 - protein, 252 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSSASTGGGGSGGGGSGGGGSGGGGSQSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVLG

SEQ ID NO: 345 - protein, 220 aa, Artificial Sequence
  Description of Artificial Sequence: Synthetic polypeptide
EVQLLESGGGLVQPGGSLRLSCAASGFTFSAYGMGWVRQAPGKGLEWVSYISPSGGHTKYADSVKGRFTISRDNSKNTLYLQMNSLRAEDTAVYYCAKVLETGLLVDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 346 - protein, 212 aa, Artificial Sequence
  Description of Artificial Sequence: Synthetic polypeptide
QYELTQPPSVSVYPGQTASITCSGDQLGSKFVSWYQQRPGQSPVLVMYKDKRRPSEIPERFSGSNSGNTATLTISGTQAIDEADYYCQAWDSSTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 347 - protein, 252 aa, Artificial Sequence
  Description of Artificial Sequence: Synthetic polypeptide
EVQLLESGGGLVQPGGSLRLSCAASGFTFSAYGMGWVRQAPGKGLEWVSYISPSGGHTKYADSVKGRFTISRDNSKNTLYLQMNSLRAEDTAVYYCAKVLETGLLVDAFDIWGQGTMVTVSSASTGGGGSGGGGSGGGGSGGGGSQYELTQPPSVSVYPGQTASITCSGDQLGSKFVSWYQQRPGQSPVLVMYKDKRRPSEIPERFSGSNSGNTATLTISGTQAIDEADYYCQAWDSSTYVFGTGTKVTVLG

SEQ ID NO: 348 - protein, 216 aa, Artificial Sequence
  Description of Artificial Sequence: Synthetic polypeptide
EVQLLESGGGLVQPGGSLRLSCAASGFTFSWYGMGWVRQAPGKGLEWVSYISPSGGITVYADSVKGRFTISRDNSKNTLYLQMNSLRAEDTAVYYCARLNYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 349 - protein, 214 aa, Artificial Sequence
  Description of Artificial Sequence: Synthetic polypeptide
DIQMTQSPSSLSASVGDRITITCQASQDIGDSLNWYQQKPGKAPRLLIYDASNLETGVPPRFSGSGSGTDFTFTFRSLQPEDIATYFCQQSANAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 350 - protein, 250 aa, Artificial Sequence
  Description of Artificial Sequence: Synthetic polypeptide
EVQLLESGGGLVQPGGSLRLSCAASGFTFSWYGMGWVRQAPGKGLEWVSYISPSGGITVYADSVKGRFTISRDNSKNTLYLQMNSLRAEDTAVYYCARLNYYYGLDVWGQGTTVTVSSASTGGGGSGGGGSGGGGSGGGGSDIQMTQSPSSLSASVGDRITITCQASQDIGDSLNWYQQKPGKAPRLLIYDASNLETGVPPRFSGSGSGTDFTFTFRSLQPEDIATYFCQQSANAPFTFGPGTKVDIKRT

SEQ ID NO: 351 - protein, 217 aa, Artificial Sequence
  Description of Artificial Sequence: Synthetic polypeptide
EVQLLESGGGLVQPGGSLRLSCAASGFTFSRYGMWWVRQAPGKGLEWVSYIGSSGGPTYYVDSVKGRFTISRDNSKNTLYLQMNSLRAEDTAVYYCAGGRGTPYYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 352 - protein, 216 aa, Artificial Sequence
  Description of Artificial Sequence: Synthetic polypeptide
QYELTQPASVSGSPGQSITISCTGTSSDIGRWNIVSWYQQHPGKAPKLMIYDVSNRPSGVSNRFSGSKSGNTASLTISGLQAEDEADYYCSSYTSSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 353 - protein, 253 aa, Artificial Sequence
  Description of Artificial Sequence: Synthetic polypeptide
EVQLLESGGGLVQPGGSLRLSCAASGFTFSRYGMWWVRQAPGKGLEWVSYIGSSGGPTYYVDSVKGRFTISRDNSKNTLYLQMNSLRAEDTAVYYCAGGRGTPYYFDSWGQGTLVTVSSASTGGGGSGGGGSGGGGSGGGGSQYELTQPASVSGSPGQSITISCTGTSSDIGRWNIVSWYQQHPGKAPKLMIYDVSNRPSGVSNRFSGSKSGNTASLTISGLQAEDEADYYCSSYTSSSTWVFGGGTKLTVLG

SEQ ID NO: 354 - DNA, 2154 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggaggagggtttcgattactggggtcagggaaccctggtaacggtgtcgagcgctagcactaagggaccgtccgtgtttcccctcgcgccttgcagccgctcgacgagcgaatcgacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcaaacttcggaacgcagacgtacacatgtaatgtcgatcacaagccctccaatactaaggtagataagaccgtagaacgaaagtgttgtgtcgaatgccctccgtgccccgcaccaccggtcgcgggtccatcagtctttctgttcccgccaaagcccaaagacacactgatgatttcgcgcacgcccgaagtcacttgcgtcgtggtggatgtgtcgcatgaggacccggaggtccaattcaactggtacgtcgatggtgtagaagtccacaacgccaagaccaagcctcgggaggagcagttcaactccacctttcgggtagtgagcgtgcttacagtagtgcatcaggactggctgaacggcaaagaatacaaatgcaaagtcagcaacaaaggactgccagcgcccatcgagaaaacaattagcaaaactaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccaatgttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 355 - protein, 716 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 356 - DNA, 2154 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtacctccaaatgaattcgcttagggcagaagatacggccttgtactattgcgcaagggaccttgggtacaaccagtggtgggaaggtttcgattactggggtcagggaaccctggtaacggtgtcgagcgctagcactaagggaccgtccgtgtttcccctcgcgccttgcagccgctcgacgagcgaatcgacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcaaacttcggaacgcagacgtacacatgtaatgtcgatcacaagccctccaatactaaggtagataagaccgtagaacgaaagtgttgtgtcgaatgccctccgtgccccgcaccaccggtcgcgggtccatcagtctttctgttcccgccaaagcccaaagacacactgatgatttcgcgcacgcccgaagtcacttgcgtcgtggtggatgtgtcgcatgaggacccggaggtccaattcaactggtacgtcgatggtgtagaagtccacaacgccaagaccaagcctcgggaggagcagttcaactccacctttcgggtagtgagcgtgcttacagtagtgcatcaggactggctgaacggcaaagaatacaaatgcaaagtcagcaacaaaggactgccagcgcccatcgagaaaacaattagcaaaactaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccaatgttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataa

SEQ ID NO: 357 - protein, 716 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 358 - protein, 451 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 359 - protein, 451 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 360 - protein, 451 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 361 - protein, 451 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 362 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 363 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 364 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 365 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 366 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 367 - protein, 254 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 368 - protein, 254 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 369 - protein, 254 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 370 - protein, 254 aa, Artificial Sequence
  Description of Artificial Sequence: Synthetic polypeptide
QVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 371 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 372 - protein, 254 aa, Artificial Sequence
  Description of Artificial Sequence: Synthetic polypeptide
QVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 373 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 374 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 375 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 376 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVSSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 377 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVSSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 378 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 379 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 380 - protein, 214 aa, Artificial Sequence
  Description of Artificial Sequence: Synthetic polypeptide
DIQMTQSPSSLSASTGDRVTITCRASQGISSYLAWYQQKPGKAPKLLIYARSTRQSGVPSRFSGSGSGTDFTLTISSLQPEDFATYYCQQYWRWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 381 - protein, 214 aa, Artificial Sequence
  Description of Artificial Sequence: Synthetic polypeptide
DIQMTQSPSSLSASTGDRVTITCRASQGISSYLAWYQQKPGKAPKLLIYAKSTLQSGVPSRFSGSGSGTDFTLTISSLQPEDFATYYCQQYWTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 254 aa, Artificial Sequence
  Description of Artificial Sequence: Synthetic polypeptide
EVQLLQSGGGLVQPGGSLRLSCAASGFLFSSYPMHWVRQAPGKGLEWVGSISPSGGATPYADSVKGRFTISRDNSKNTLYLQMNSLRPEDTAVYYCAKDFYNILTGNAFDKWGQGTSVTVSSASTGGGGSGGGGSGGGGSGGGGSDIQLTQSPSSLSASLGDRVTITCRASQGISSYLAWYQQKPGKAPKLLIYAGSTPQSGVPSRFSGSGSGTEFTLTISSLQPEDSGTYYCQQYWTWPLTFGGGTKVEIKRT

SEQ ID NO: 383 - protein, 254 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 384 - protein, 122 aa, Artificial Sequence; identical to SEQ ID NO: 10
  Description of Artificial Sequence: Synthetic polypeptide

SEQ ID NO: 385 - protein, 122 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSS

SEQ ID NO: 386 - protein, 107 aa, Artificial Sequence
  Description of Artificial Sequence: Synthetic polypeptide
DIQMTQSPSSLSASTGDRVTITCRASQGISSYLAWYQQKPGKAPKLLIYAKSTLQSGVPSRFSGSGSGTDFTLTISSLQPEDFATYYCQQYWTFPLTFGGGTKVEIK

SEQ ID NO: 387 - protein, 107 aa, Artificial Sequence
  Description of Artificial Sequence: Synthetic polypeptide
DIQMTQSPSSLSASTGDRVTITCRASQGISSYLAWYQQKPGKAPKLLIYARSTRQSGVPSRFSGSGSGTDFTLTISSLQPEDFATYYCQQYWRWPLTFGGGTKVEIK

SEQ ID NO: 388 - protein, 122 aa, Artificial Sequence; identical to SEQ ID NO: 141
  Description of Artificial Sequence: Synthetic polypeptide

SEQ ID NO: 389 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVSSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 390 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 391 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFLFSSYPMHWVRQAPGKGLEWVGSISPSGGATPYADSVKGRFTISRDNSKNTLYLQMNSLRPEDTAVYYCAKDFYNILTGNAFDKWGQGTSVTVSSASTGGGGSGGGGSGGGGSGGGGSDIQLTQSPSSLSASLGDRVTITCRASQGISSYLAWYQQKPGKAPKLLIYAGSTPQSGVPSRFSGSGSGTEFTLTISSLQPEDSGTYYCQQYWTWPLTFGGGTKVEIKRT

SEQ ID NO: 392 - protein, 4 aa, Artificial Sequence
  Description of Artificial Sequence: Synthetic peptide
ASTK

SEQ ID NO: 393 - protein, 5 aa, Artificial Sequence
  Description of Artificial Sequence: Synthetic peptide
RTVAA

SEQ ID NO: 394 - protein, 5 aa, Artificial Sequence
  Description of Artificial Sequence: Synthetic peptide
QPKAA

SEQ ID NO: 395 - protein, 100 aa, Artificial Sequence
  Description of Artificial Sequence: Synthetic polypeptide
  misc_feature (1)..(100): This sequence may encompass 1-20 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 396 - protein, 15 aa, Artificial Sequence
  Description of Artificial Sequence: Synthetic peptide
GGGGSGGGGSGGGGS

SEQ ID NO: 397 - protein, 20 aa, Artificial Sequence
  Description of Artificial Sequence: Synthetic peptide
GGGGSGGGGSGGGGSGGGGS

SEQ ID NO: 398 - protein, 25 aa, Artificial Sequence
  Description of Artificial Sequence: Synthetic peptide
GGGGSGGGGSGGGGSGGGGSGGGGS

SEQ ID NO: 399 - protein, 5 aa, Artificial Sequence
  Description of Artificial Sequence: Synthetic peptide
GGGGS

SEQ ID NO: 400 - protein, 18 aa, Artificial Sequence
  Description of Artificial Sequence: Synthetic peptide
ASTGGGGSGGGGSGGGGS

SEQ ID NO: 401 - protein, 50 aa, Artificial Sequence
  Description of Artificial Sequence: Synthetic polypeptide
  misc_feature (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 402 - protein, 23 aa, Artificial Sequence
  Description of Artificial Sequence: Synthetic peptide
ASTGGGGSGGGGSGGGGSGGGGS

SEQ ID NO: 403 - protein, 6 aa, Artificial Sequence
  Description of Artificial Sequence: Synthetic 6xHis tag
HHHHHH

SEQ ID NO: 404 - protein, 324 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 405 - protein, 734 aa, Artificial Sequence
  Description of Artificial Sequence: Synthetic polypeptide
MGFGLSWLFLVAILKGVQCEVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 406 - protein, 734 aa, Artificial Sequence
  Description of Artificial Sequence: Synthetic polypeptide
MGFGLSWLFLVAILKGVQCEVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 407 - protein, 739 aa, Artificial Sequence
  Description of Artificial Sequence: Synthetic polypeptide
MGFGLSWLFLVAILKGVQCEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 408 - protein, 739 aa, Artificial Sequence
  Description of Artificial Sequence: Synthetic polypeptide
MGFGLSWLFLVAILKGVQCEVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 409 - DNA, 2231 bp, Artificial Sequence
  Description of Artificial Sequence: Synthetic polynucleotide
ccatgggcttcgggttgtcgtggctctttttggtcgcaatcttgaagggtgtccagtgcgaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcagtgggctatgccgattccgtaaagggtaggttcaccatctcacgcgacaatgcgaagaattcgttgtacctccaaatgaattcgcttagggcagaagatacggccttgtactattgcgcaagggaccttgggtacaaccagtggtgggaaggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggtgggggttccgggggtgggggatccggtggaggagggtccgaggtccaactgctgcagtccggcggagggctcgtgcagcctggcggtagcctgagactttcgtgtgcggccagcgggtttgacttttcatcatatcccatgcactgggtgagacaagctccggggaaaggtcttgaatgggtcggctccatttcgtcatcgggtggtgcgaccccgtacgccgattcggtgaagggacgattcaccatctcgcgggataactcgaagaacactctttatctccagatgaattcgctgaggcccgaagatacggcagtgtattactgtgcgaaagacttctatacgattttgactggcaatgcattcgacatgtggggccagggaacgtcggtaacagtctcaagcgcatcaacaggtggtggagggtcgggaggaggaggaagcggtgggggagggtcagggggaggcggatcggacatccagatgacccagtccccttcctcgctctccgcgtccttgggtgaccgcgtaacgatcacatgcagagcaagccaaggaatttcaagctatcttgcgtggtatcagcagaagccgggtaaagcgcccaagttgttgatctacgccagctccacaaggcagtcgggggtcccctcacgcttttcggggtcgggctcgggaactgacttcaccttgacgatctccagcctccagccagaggattcagggacctactactgccaacagtactgggcgtttcccctgacattcggagggggaacaaaagtagagatcaagcggacgtgataatctaga

SEQ ID NO: 410 - protein, 739 aa, Artificial Sequence
  Description of Artificial Sequence: Synthetic polypeptide
MGFGLSWLFLVAILKGVQCEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 411 - DNA, 2231 bp, Artificial Sequence
  Description of Artificial Sequence: Synthetic polynucleotide
ccatgggctttgggctgtcgtggctttttcttgtcgcgatcctcaagggagtgcagtgcgaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcctggcggtggaggagggtcaggaggcggagggtcgggaggtggcgggtcgcaagtccagttggtccagtcgggaggcggactcgtccagcccggaggttcgcttcgattgtcgtgtgccgcatccggattcacttttgacgactacgcgatgcactgggtgagacaggctccggggaaagggctggagtgggtggcggggatttcgtgggattccgggagcaccggatacgccgactccgtgaaaggacggttcacgatttcaagagataatgccaagaactcgctctatttgcagatgaattcacttagggctgaagatacagcgttgtactactgtgcgcgcgaccttggagcatatcagtgggtggagggcttcgattactggggccaagggactcttgtgacagtctcaagcgcctcgacaggaggaggtggatcaggtggtggaggttcagggggagggggttcgggaggaggaggatccagctatgaactgacacaagatcccgcagtgtcggtagcgctcgggcagactgtacgcatcacctgccagggggactcactgcggagctattacgcgtcgtggtatcagcaaaagccaggacaggcgccagtgctggtcatctacgggaagaacaaccggccctcggggatcccggacaggttctccgggtccaccagcggtaactccgcttcactcacgatcacaggggcccaggccgaggacgaagcggactattactgcaacagccgagatagcccgggtaatcaatgggtatttgggggtggtacgaaagtaacggtgcttggctgataatctaga

SEQ ID NO: 412 - protein, 739 aa, Artificial Sequence
  Description of Artificial Sequence: Synthetic polypeptide
MGFGLSWLFLVAILKGVQCEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 413 - DNA, 2231 bp, Artificial Sequence
  Description of Artificial Sequence: Synthetic polynucleotide
ccatgggctttgggctgtcgtggctttttcttgtcgcgatcctcaagggagtgcagtgcgaagtccagctgctccaaagcggcggaggactcgtacagccgggagggagcttgaggctcagctgcgctgcgtccggtttcatgttctcaagatatcccatgcactgggtgcggcaggcaccaggaaagggactggagtgggtcggttcgatttcgggctccggtggggcaaccccttatgccgattccgtcaaagggcgctttaccatttcaagggataacagcaagaacactttgtacttgcaaatgaattcgcttcgagcggaggacacagccgtgtactactgtgcgaaagacttttaccagatcttgacaggtaatgccttcgactattgggggcaggggacaacggtaacggtgtcgtccgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggcggagggtcaggtgggggtggttcgggcggagggggatcccaagtgcagctggtccagtcgggtgggggcttggtgcagccgggtggatcactgcgcctttcgtgcgccgcaagcgggtttacattcgatgattacgcgatgcattgggtgagacaggcacctggtaaagggcttgaatgggtggcagggatctcatggaattcgggatccattggatacgcagactcagtcaagggacgcttcacgatcagccgggacaatgcgaagaactcactgtatcttcagatgaattcgctcagacccgaggacaccgcagtgtactattgtgcccgcgaccttggctacaatcaatgggtagagggtttcgattattggggacagggaacgcttgtcactgtctccagcgcgtccacgggagggggaggtagcggtgggggagggtccgggggagggggttccggcggaggagggtcatcgtatgaactcacacaagatcccgcggtatccgtggcgctcggtcagacagtaaggattacatgtcagggagacagcttgcgatcctactatgcgagctggtatcagcagaaaccgggacaggcgccagtgttggtcatctacgggaaaaacaaccggccttcgggaatcccggaccggttttcgggtagcacttcggggaattcggcgtcactgactattacgggagcgcaagctgaagatgaggccgactactactgcaacagccgagattcctcggggaaccactgggtgtttggaggcggtacgaaggtcaccgtcttggggtgataatctaga

SEQ ID NO: 414 - protein, 235 aa, Artificial Sequence
  Description of Artificial Sequence: Synthetic polypeptide
MAWRLWWLLLLLLLLWPMVWASSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVIGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 415 - DNA, 719 bp, Artificial Sequence
  Description of Artificial Sequence: Synthetic polynucleotide
ccatggcctggcggttgtggtggcttttgctcctccttctgttgctttggcctatggtgtgggcctcaagcgaattgacccaagaccccgcagtctccgtggcgcttgggcaaactgtgagaatcacgtgtcaaggagacagccttagaagctactatgcctcgtggtatcagcagaagccaggtcaggccccagtcctcgtgatctacgggaagaacaaccgcccctcgggtattcccgaccgcttttcgggatcgtcctccggaaatacggcttccctgacgatcaccggagcccaagcggaagatgaggcggattactattgcaactcacgggacacgccgggtaacaagtgggtattcgggggaggcactaaagtaacagtgattggccagcctaaagcggcaccgtcggtgactctctttcccccgtcatcggaagagcttcaggcgaataaggcgacactggtatgcttggtcagcgatttctacccgggagccgtaacggtcgcgtggaaagcggacgggtcgcccgtgaaagtcggggtcgagacaacgaaaccctcaaaacagtcgaataacaagtacgcggcatcatcatatctctcattgacccctgaacagtggaagagccataggtcgtactcgtgtcgagtcacacacgagggatccaccgtagaaaagacagtggctcctgccgagtgttcctgataatctaga

SEQ ID NO: 416 - protein, 234 aa, Artificial Sequence
  Description of Artificial Sequence: Synthetic polypeptide
MGTPAQLLFLLLLWLPDTTGDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - DNA, 716 bp, Artificial Sequence
  Description of Artificial Sequence: Synthetic polynucleotide
ccatgggcactcccgcgcagctccttttcctccttttgctttggttgccggacacgacaggcgatattcaaatgacacagtcaccctcgtcactcagcgccagccttggggaccgcgtaacgatcacgtgtagagcgtcgcaggggatttcctcgtatctggcgtggtatcagcaaaagcctggtaaagctccgaaactcctgatctacgccaagtcgaccttgcagtccggagtcccctcaaggttcagcgggtcgggatccggtacagatttcaccctgaccatctcaagcctccagccagaggactccgcaacgtactattgccagcagtactggacgtttcctttgacttttggaggcggaacaaaggtggaaatcaaacgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataatctaga

SEQ ID NO: 418 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 419 - DNA, 2166 bp, Artificial Sequence
  Description of Artificial Sequence: Synthetic polynucleotide
gaggtgcagcttctccaatcgggaggcgggctggtccagccgggtggttcacttcggctctcatgtgcagcgtcggggtttatgttcagcaggtatcctatgcactgggtacgacaagccccagggaagggtttggagtgggtgagctcgatctccggatcaggtggagccacaccctatgcggacagcgtcaaggggcgcttcaccatctccagagacaatagcaaaaacacgctgtatcttcagatgaactcgctccgggcagaagatactgcggtgtactactgcgctaaggatttctaccagattttgaccggcaatgcgtttgactactggggacagggaacaacggtcacggtgtcgtcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcctggcggtggaggagggtcaggaggcggagggtcgggaggtggcgggtcgcaagtccagttggtccagtcgggaggcggactcgtccagcccggaggttcgcttcgattgtcgtgtgccgcatccggattcacttttgacgactacgcgatgcactgggtgagacaggctccggggaaagggctggagtgggtggcggggatttcgtgggattccgggagcaccggatacgccgactccgtgaaaggacggttcacgatttcaagagataatgccaagaactcgctctatttgcagatgaattcacttagggctgaagatacagcgttgtactactgtgcgcgcgaccttggagcatatcagtgggtggagggcttcgattactggggccaagggactcttgtgacagtctcaagcgcctcgacaggaggaggtggatcaggtggtggaggttcagggggagggggttcgggaggaggaggatccagctatgaactgacacaagatcccgcagtgtcggtagcgctcgggcagactgtacgcatcacctgccagggggactcactgcggagctattacgcgtcgtggtatcagcaaaagccaggacaggcgccagtgctggtcatctacgggaagaacaaccggccctcggggatcccggacaggttctccgggtccaccagcggtaactccgcttcactcacgatcacaggggcccaggccgaggacgaagcggactattactgcaacagccgagatagcccgggtaatcaatgggtatttgggggtggtacgaaagtaacggtgcttggctgataa

SEQ ID NO: 420 - DNA, 2166 bp, Artificial Sequence
  Description of Artificial Sequence: Synthetic polynucleotide
gaggtgcagcttctccaatcgggaggcgggctggtccagccgggtggttcacttcggctctcatgtgcagcgtcggggtttatgttcagcaggtatcctatgcactgggtacgacaagccccagggaagggtttggagtgggtgagctcgatctccggatcaggtggagccacaccctatgcggacagcgtcaaggggcgcttcaccatctccagagacaatagcaaaaacacgctgtatcttcagatgaactcgctccgggcagaagatactgcggtgtactactgcgctaaggatttctaccagattttgaccggcaatgcgtttgactactggggacagggaacaacggtcacggtgtcgtcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggcggagggtcaggtgggggtggttcgggcggagggggatcccaagtgcagctggtccagtcgggtgggggcttggtgcagccgggtggatcactgcgcctttcgtgcgccgcaagcgggtttacattcgatgattacgcgatgcattgggtgagacaggcacctggtaaagggcttgaatgggtggcagggatctcatggaattcgggatccattggatacgcagactcagtcaagggacgcttcacgatcagccgggacaatgcgaagaactcactgtatcttcagatgaattcgctcagacccgaggacaccgcagtgtactattgtgcccgcgaccttggctacaatcaatgggtagagggtttcgattattggggacagggaacgcttgtcactgtctccagcgcgtccacgggagggggaggtagcggtgggggagggtccgggggagggggttccggcggaggagggtcatcgtatgaactcacacaagatcccgcggtatccgtggcgctcggtcagacagtaaggattacatgtcagggagacagcttgcgatcctactatgcgagctggtatcagcagaaaccgggacaggcgccagtgttggtcatctacgggaaaaacaaccggccttcgggaatcccggaccggttttcgggtagcacttcggggaattcggcgtcactgactattacgggagcgcaagctgaagatgaggccgactactactgcaacagccgagattcctcggggaaccactgggtgtttggaggcggtacgaaggtcaccgtcttggggtgataa

SEQ ID NO: 421 - DNA, 2166 bp, Artificial Sequence
  Description of Artificial Sequence: Synthetic polynucleotide
gaggtgcagcttctccaatcgggaggcgggctggtccagccgggtggttcacttcggctctcatgtgcagcgtcggggtttatgttcagcaggtatcctatgcactgggtacgacaagccccagggaagggtttggagtgggtgagctcgatctccggatcaggtggagccacaccctatgcggacagcgtcaaggggcgcttcaccatctccagagacaatagcaaaaacacgctgtatcttcagatgaactcgctccgggcagaagatactgcggtgtactactgcgctaaggatttctaccagattttgaccggcaatgcgtttgactactggggacagggaacaacggtcacggtgtcgtcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggagggggagggagcggcggtggagggtccggaggtggaggaagcgaggtgcagctcgtggagtcgggagggggactcgtccagcccgggagaagccttaggctctcgtgtgccgcctcggggtttacgttcgatgactatgccatgcattgggtcagacaggcaccaggaaaaggtcttgaatgggtgtccggaatctcatggaactccgggtcaacaggatacgctgattccgtaaaaggccgcttcaccatctccagagacaatgcgaagaactcattgtacctccagatgaactcactcagggcggaggacaccgcactgtactactgcgccagggacctcgggtacaaccagtggttggaggggtttgattattggggtcaggggaccttggtcacagtaagctccgccagcacagggggtggcggatccggaggcggtggcagcggaggaggtggatccgggggtggtgggtcgtcaagcgagctgactcaagatccggcggtgtcagtcgcgcttggacagacagtgcgcattacgtgccagggcgactcgcttcggagctactatgcgtcatggtatcaacagaagccgggtcaagcgcctgtgttggtcatctacgggaagaacaatcggccctcggggatccctgaccgattcagcggttcatcatccggtaatacggcatcgcttactattacgggagcacaggcggaagatgaagccgattactattgtatgtcgcgggaccacccggggaatcagtgggtgtttgggggaggaactaaagtaacggtattggggtgataa

SEQ ID NO: 422 - DNA, 2166 bp, Artificial Sequence
  Description of Artificial Sequence: Synthetic polynucleotide
gaggtacagctgcttcagtccgggggaggactcgtccagccgggaggatcgctccgcctttcatgcgctgcctccggcttcttcttctcgaaatatcctatgcactgggtgcgacaggctcccgggaagggcttggaatgggtcagcagcatcagctcggacggaggggccacggtgtacgcggattcggtcaagggtaggtttacgatctcgcgggataactcaaagaataccctgtatctccaaatgaactccttgagagcagaggacacagcggtatactattgtgcgaaagacttttacacaatcctgacaggtaatgcgtttgatacgtggggtcaggggactaccgtaactgtgtcatcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcctggcggtggaggagggtcaggaggcggagggtcgggaggtggcgggtcgcaagtccagttggtccagtcgggaggcggactcgtccagcccggaggttcgcttcgattgtcgtgtgccgcatccggattcacttttgacgactacgcgatgcactgggtgagacaggctccggggaaagggctggagtgggtggcggggatttcgtgggattccgggagcaccggatacgccgactccgtgaaaggacggttcacgatttcaagagataatgccaagaactcgctctatttgcagatgaattcacttagggctgaagatacagcgttgtactactgtgcgcgcgaccttggagcatatcagtgggtggagggcttcgattactggggccaagggactcttgtgacagtctcaagcgcctcgacaggaggaggtggatcaggtggtggaggttcagggggagggggttcgggaggaggaggatccagctatgaactgacacaagatcccgcagtgtcggtagcgctcgggcagactgtacgcatcacctgccagggggactcactgcggagctattacgcgtcgtggtatcagcaaaagccaggacaggcgccagtgctggtcatctacgggaagaacaaccggccctcggggatcccggacaggttctccgggtccaccagcggtaactccgcttcactcacgatcacaggggcccaggccgaggacgaagcggactattactgcaacagccgagatagcccgggtaatcaatgggtatttgggggtggtacgaaagtaacggtgcttggctgataa

SEQ ID NO: 423 - DNA, 2166 bp, Artificial Sequence
  Description of Artificial Sequence: Synthetic polynucleotide
gaggtacagctgcttcagtccgggggaggactcgtccagccgggaggatcgctccgcctttcatgcgctgcctccggcttcttcttctcgaaatatcctatgcactgggtgcgacaggctcccgggaagggcttggaatgggtcagcagcatcagctcggacggaggggccacggtgtacgcggattcggtcaagggtaggtttacgatctcgcgggataactcaaagaataccctgtatctccaaatgaactccttgagagcagaggacacagcggtatactattgtgcgaaagacttttacacaatcctgacaggtaatgcgtttgatacgtggggtcaggggactaccgtaactgtgtcatcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggaggcggagggtcaggtgggggtggttcgggcggagggggatcccaagtgcagctggtccagtcgggtgggggcttggtgcagccgggtggatcactgcgcctttcgtgcgccgcaagcgggtttacattcgatgattacgcgatgcattgggtgagacaggcacctggtaaagggcttgaatgggtggcagggatctcatggaattcgggatccattggatacgcagactcagtcaagggacgcttcacgatcagccgggacaatgcgaagaactcactgtatcttcagatgaattcgctcagacccgaggacaccgcagtgtactattgtgcccgcgaccttggctacaatcaatgggtagagggtttcgattattggggacagggaacgcttgtcactgtctccagcgcgtccacgggagggggaggtagcggtgggggagggtccgggggagggggttccggcggaggagggtcatcgtatgaactcacacaagatcccgcggtatccgtggcgctcggtcagacagtaaggattacatgtcagggagacagcttgcgatcctactatgcgagctggtatcagcagaaaccgggacaggcgccagtgttggtcatctacgggaaaaacaaccggccttcgggaatcccggaccggttttcgggtagcacttcggggaattcggcgtcactgactattacgggagcgcaagctgaagatgaggccgactactactgcaacagccgagattcctcggggaaccactgggtgtttggaggcggtacgaaggtcaccgtcttggggtgataa

SEQ ID NO: 424 - DNA, 2166 bp, Artificial Sequence
  Description of Artificial Sequence: Synthetic polynucleotide
gaggtacagctgcttcagtccgggggaggactcgtccagccgggaggatcgctccgcctttcatgcgctgcctccggcttcttcttctcgaaatatcctatgcactgggtgcgacaggctcccgggaagggcttggaatgggtcagcagcatcagctcggacggaggggccacggtgtacgcggattcggtcaagggtaggtttacgatctcgcgggataactcaaagaataccctgtatctccaaatgaactccttgagagcagaggacacagcggtatactattgtgcgaaagacttttacacaatcctgacaggtaatgcgtttgatacgtggggtcaggggactaccgtaactgtgtcatcggctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttatcgcccggaggagggggagggagcggcggtggagggtccggaggtggaggaagcgaggtgcagctcgtggagtcgggagggggactcgtccagcccgggagaagccttaggctctcgtgtgccgcctcggggtttacgttcgatgactatgccatgcattgggtcagacaggcaccaggaaaaggtcttgaatgggtgtccggaatctcatggaactccgggtcaacaggatacgctgattccgtaaaaggccgcttcaccatctccagagacaatgcgaagaactcattgtacctccagatgaactcactcagggcggaggacaccgcactgtactactgcgccagggacctcgggtacaaccagtggttggaggggtttgattattggggtcaggggaccttggtcacagtaagctccgccagcacagggggtggcggatccggaggcggtggcagcggaggaggtggatccgggggtggtgggtcgtcaagcgagctgactcaagatccggcggtgtcagtcgcgcttggacagacagtgcgcattacgtgccagggcgactcgcttcggagctactatgcgtcatggtatcaacagaagccgggtcaagcgcctgtgttggtcatctacgggaagaacaatcggccctcggggatccctgaccgattcagcggttcatcatccggtaatacggcatcgcttactattacgggagcacaggcggaagatgaagccgattactattgtatgtcgcgggaccacccggggaatcagtgggtgtttgggggaggaactaaagtaacggtattggggtgataa

SEQ ID NO: 425 - DNA, 2166 bp, Artificial Sequence
  Description of Artificial Sequence: Synthetic polynucleotide
gaggtccagctcgtcgagtcaggtggaggactggtgcaacccggtcgatcacttcggctgtcgtgtgcggcatcgggattcacgtttgacgattatgccatgcattgggtgcgacaagctccgggcaaagggcttgaatgggtgtccggaatctcgtgggattcggggtcaacgggctatgccgattccgtaaagggtaggttcaccatctcacgcgacaatgcgaagaattcgttgtatcttcagatgaattcgcttagggcagaagatacggccttgtactattgcgcaagggaccttggggcgtaccagtgggtcgagggtttcgattactggggtcagggaaccctggtaacggtgtcgagcgctagcactaagggaccgtccgtgtttcccctcgcgcctagctcgaagagcacatcgggaggaacagcggcgctcggctgtctcgtcaaagactacttccccgagccggtgaccgtgagctggaattccggagcgttgacctcaggggtgcatacattccctgccgtactgcaatcatcagggctctactcattgtcgagcgtagtgactgtaccgtcgtcatcgctcggaacgcagacgtacatctgcaatgtcaatcacaagccctccaatactaaggtagataagaaagtagaaccgaagtcgtgtgataagacccatacatgccctccgtgccccgcaccggaactcttgggtggcccatcagtctttctgttcccgccaaagcccaaagacacactgatgatttcgcgcacgcccgaagtcacttgcgtcgtggtggatgtgtcgcatgaggacccggaggtcaagttcaactggtacgtcgatggtgtagaagtccacaacgccaagaccaagcctcgggaggagcagtataactccacctaccgggtagtgagcgtgcttacagtgctccatcaggactggctgaacggcaaagaatacaaatgcaaagtcagcaacaaagcgctgccagcgcccatcgagaaaacaattagcaaagcgaaagggcagcccagagaacctcaagtgtatacattgccgccgtcgcgggaggaaatgacaaagaatcaggtatccctgacgtgtcttgtgaaaggcttttacccatccgacattgcggtagagtgggagtcgaatgggcaacccgagaacaactataagacgactcccccagtcttggattcagacggatcctttttcttgtactcgaaactcacagtcgacaagtccagatggcagcaggggaacgtgttcagctgcagcgtgatgcacgaggcccttcacaaccactatacgcagaaatcattaagcttaagccccggtggtggtgggggatcaggagggggtggaagcggaggtggcgggagcgaggtccaacttctccagagcgggggagggttggtgcagccgggtgggtccctgcgcctttcgtgcgctgcctccggatttctcttcagctcatatcctatgcactgggtgcgccaggcaccagggaaaggccttgagtgggtcgggtcgatctcgccatccggtggagccacgccctacgcagatagcgtaaaagggcgattcaccatttcgcgggacaattcaaagaacaccctctaccttcagatgaactcgttgaggcccgaggacacagccgtgtactactgcgcgaaggatttctataacattctgacgggtaatgcgtttgataagtggggacagggtacttcggtcacggtgtcgtcagcctcgactggtggaggtgggtccggtgggggtggatcaggtggaggagggtcgggaggagggggatccgacatccagctcacacagtccccctcgtcgttgtcagcgagcctgggtgatcgggtaactatcacatgtagagcatcccagggcatttcatcctatttggcgtggtatcagcagaagcccgggaaagcgcctaagttgctgatctacgcgggatcgacgccgcaatcaggggtgccctcaagattttcggggtcggggagcggaacagaattcacactcacaatctcctcgctccaaccggaggactcagggacctattactgtcagcaatactggacttggccgctgacctttggagggggcacgaaggtcgaaatcaaaaggacgtgataa

SEQ ID NO: 426 - DNA, 648 bp, Artificial Sequence
  Description of Artificial Sequence: Synthetic polynucleotide
gatatccaaatgacgcagtcgccatcgtcgctgagcgcgtcaaccggtgatagagtcacaattacatgcagggcgtcgcagggcatttcatcatacttggcatggtatcaacagaaaccggggaaagcgcccaagttgctcatctacgcccggtccacacgacagagcggtgtacctagccggttctcgggatcggggtccgggacggacttcaccctgaccatctcctcacttcagccggaggactttgctacgtactattgtcagcaatattggcgctggccccttactttcgggggaggaacaaaggtggaaatcaagcgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataa

SEQ ID NO: 427 - DNA, 648 bp, Artificial Sequence
  Description of Artificial Sequence: Synthetic polynucleotide
gatattcagatgacgcagtcaccgtccagcctttcggcctcgactggggaccgggtaaccattacatgtagagcgtcgcaaggtatctcctcctatttggcctggtatcagcagaaacccggaaaagctcccaagctgctgatctacgcaaagtcaacattgcagagcggagtccctagcaggttctcgggatcaggttcggggactgattttacgcttacaatctcgtcactgcagccggaggactttgcgacgtattactgccagcaatactggacgttcccgctgacatttggcggagggaccaaggtggaaatcaaacgtacggtcgcagctccttcggtattcatctttccgccctccgatgagcagctcaaatccggtacagcctcggtggtgtgcctgctgaataacttctatccccgggaggcgaaagtgcagtggaaagtggacaacgcgctccaatcaggaaattcccaagaatcagtcacagaacaggattcgaaagactcgacctactcactttcgtcgaccttgacgctctccaaggccgactacgagaaacacaaggtgtatgcgtgtgaagtcacacatcaagggctttcatccccagtcacgaagtcattcaaccgcggtgaatgttgataa

SEQ ID NO: 428 - DNA, 768 bp, Artificial Sequence
  Description of Artificial Sequence: Synthetic polynucleotide
gaggtccaacttctccagagcgggggagggttggtgcagccgggtgggtccctgcgcctttcgtgcgctgcctccggatttctcttcagctcatatcctatgcactgggtgcgccaggcaccagggaaaggccttgagtgggtcgggtcgatctcgccatccggtggagccacgccctacgcagatagcgtaaaagggcgattcaccatttcgcgggacaattcaaagaacaccctctaccttcagatgaactcgttgaggcccgaggacacagccgtgtactactgcgcgaaggatttctataacattctgacgggtaatgcgtttgataagtggggacagggtacttcggtcacggtgtcgtcagcctcgactggtggaggtgggtccggtgggggtggatcaggtggaggagggtcgggaggagggggatccgacatccagctcacacagtccccctcgtcgttgtcagcgagcctgggtgatcgggtaactatcacatgtagagcatcccagggcatttcatcctatttggcgtggtatcagcagaagcccgggaaagcgcctaagttgctgatctacgcgggatcgacgccgcaatcaggggtgccctcaagattttcggggtcggggagcggaacagaattcacactcacaatctcctcgctccaaccggaggactcagggacctattactgtcagcaatactggacttggccgctgacctttggagggggcacgaaggtcgaaatcaaaaggacgtgataa

SEQ ID NO: 429 - DNA, 768 bp, Artificial Sequence
  Description of Artificial Sequence: Synthetic polynucleotide
gaggtgcagctcgtggagtcgggagggggactcgtccagcccgggagaagccttaggctctcgtgtgccgcctcggggtttacgttcgatgactatgccatgcattgggtcagacaggcaccaggaaaaggtcttgaatgggtgtccggaatctcatggaactccgggtcaacaggatacgctgattccgtaaaaggccgcttcaccatctccagagacaatgcgaagaactcattgtacctccagatgaactcactcagggcggaggacaccgcactgtactactgcgccagggacctcgggtacaaccagtggttggaggggtttgattattggggtcaggggaccttggtcacagtaagctccgccagcacagggggtggcggatccggaggcggtggcagcggaggaggtggatccgggggtggtgggtcgtcaagcgagctgactcaagatccggcggtgtcagtcgcgcttggacagacagtgcgcattacgtgccagggcgactcgcttcggagctactatgcgtcatggtatcaacagaagccgggtcaagcgcctgtgttggtcatctacgggaagaacaatcggccctcggggatccctgaccgattcagcggttcatcatccggtaatacggcatcgcttactattacgggagcacaggcggaagatgaagccgattactattgtatgtcgcgggaccacccggggaatcagtgggtgtttgggggaggaactaaagtaacggtattggggtgataa

The invention claimed is:

1. Polyvalent bispecific antibody P4–G1–M1.3 having two pairs of polypeptide chains, each pair of said two pairs comprising a heavy chain joined to a light chain by at least one heavy-light chain bond, wherein each light chain comprises the amino acid sequence set forth in SEQ ID NO:204 and each heavy chain comprises the amino acid sequence set forth in SEQ ID NO:226.

2. The polyvalent bispecific antibody of claim 1, wherein at least one of said at least one bonds is a disulfide bond.

3. The polyvalent bispecific antibody of claim 1 in a pharmaceutically acceptable carrier suitable for injection or infusion.

4. A method for treating a subject having cancer, said method comprising administering to the subject a therapeutically effective amount of the polyvalent bispecific antibody of claim 3.

5. A nucleic acid molecule encoding the heavy chain of the polyvalent bispecific antibody of claim 1.

6. Polyvalent bispecific antibody P4–G1–C8 having two pairs of polypeptide chains, each pair of said two pairs comprising a heavy chain joined to a light chain by at least one heavy-light chain bond, wherein each light chain comprises the amino acid sequence set forth in SEQ ID NO:204 and each heavy chain comprises the amino acid sequence set forth in SEQ ID NO:222.

7. The polyvalent bispecific antibody of claim 6, wherein at least one of said at least one bonds is a disulfide bond.

8. The polyvalent bispecific antibody of claim 6 in a pharmaceutically acceptable carrier suitable for injection or infusion.

9. A method for treating a subject having cancer, said method comprising administering to the subject a therapeutically effective amount of the polyvalent bispecific antibody of claim 8.

10. A nucleic acid molecule encoding the heavy chain of the polyvalent bispecific antibody of claim 6.

11. Polyvalent bispecific antibody M7–G1–M78 having two pairs of polypeptide chains, each pair of said two pairs comprising a heavy chain joined to a light chain by at least one heavy-light chain bond, wherein each light chain comprises the amino acid sequence set forth in SEQ ID NO:262 and each heavy chain comprises the amino acid sequence set forth in SEQ ID NO:284.

12. The polyvalent bispecific antibody of claim 11, wherein at least one of said at least one bonds is a disulfide bond.

13. The polyvalent bispecific antibody of claim 11 in a pharmaceutically acceptable carrier suitable for injection or infusion.

14. A method for treating a subject having cancer, said method comprising administering to the subject a therapeutically effective amount of the polyvalent bispecific antibody of claim 13.

15. A nucleic acid molecule encoding the heavy chain of the polyvalent bispecific antibody of claim 11.

* * * * *